US012630845B2

(12) United States Patent
Zolotukhin et al.

(10) Patent No.: US 12,630,845 B2
(45) Date of Patent: May 19, 2026

(54) AAV CAPSID VARIANTS FOR TARGETING HUMAN GLIOBLASTOMA CELLS

(71) Applicant: University of Florida Research Foundation, Incorporated, Gainesville, FL (US)

(72) Inventors: Sergei Zolotukhin, Gainesville, FL (US); David Tran, Gainesville, FL (US); Oleksandr Kondratov, Gainesville, FL (US)

(73) Assignee: University of Florida Research Foundation, Incorporated, Gainesville, FL (US)

( * ) Notice: Subject to any disclaimer, the term of this patent is extended or adjusted under 35 U.S.C. 154(b) by 1085 days.

(21) Appl. No.: 17/633,769

(22) PCT Filed: Aug. 7, 2020

(86) PCT No.: PCT/US2020/045526
§ 371 (c)(1),
(2) Date: Feb. 8, 2022

(87) PCT Pub. No.: WO2021/030225
PCT Pub. Date: Feb. 18, 2021

(65) Prior Publication Data
US 2022/0333136 A1 Oct. 20, 2022

Related U.S. Application Data

(60) Provisional application No. 62/884,716, filed on Aug. 9, 2019.

(51) Int. Cl.
*C12N 15/861* (2006.01)
*C07K 14/005* (2006.01)

(52) U.S. Cl.
CPC .......... *C12N 15/861* (2013.01); *C07K 14/005* (2013.01)

(58) Field of Classification Search
CPC ........................... C12N 15/861; C07K 14/005
See application file for complete search history.

(56) References Cited

U.S. PATENT DOCUMENTS

| | | | |
|---|---|---|---|
| 6,156,303 | A | 12/2000 | Russell et al. |
| 7,186,552 | B2 | 3/2007 | Wilson et al. |
| 7,220,577 | B2 | 5/2007 | Zolotukhin |
| 7,723,112 | B2 | 5/2010 | Clarke et al. |
| 7,812,124 | B2 | 10/2010 | Palm |
| 7,927,585 | B2 | 4/2011 | Snyder |
| 8,445,267 | B2 | 5/2013 | Zhong et al. |
| 9,157,098 | B2 | 10/2015 | Zhong et al. |
| 9,677,088 | B2 | 6/2017 | Nakai et al. |
| 9,725,485 | B2 | 8/2017 | Srivastava et al. |
| 10,011,640 | B2 | 7/2018 | Srivastava et al. |
| 10,308,957 | B2 | 6/2019 | Boye et al. |
| 10,426,844 | B2 | 10/2019 | Agbandje-McKenna et al. |
| 10,648,000 | B2 | 5/2020 | Hauswirth et al. |
| 10,723,768 | B2 | 7/2020 | Zhong et al. |
| 10,793,606 | B2 | 10/2020 | Zolotukhin et al. |
| 10,815,279 | B2 | 10/2020 | Srivastava et al. |
| 11,000,597 | B2 | 5/2021 | Muzyczka et al. |
| 11,091,777 | B2 | 8/2021 | Marsic et al. |
| 11,332,502 | B2 | 5/2022 | Zolotukhin et al. |
| 11,767,346 | B2 | 9/2023 | Zolotukhin et al. |
| 11,827,884 | B2 | 11/2023 | Tran et al. |
| 2004/0219575 | A1 | 11/2004 | Neuman et al. |
| 2005/0106700 | A1 | 5/2005 | Nomura et al. |
| 2006/0034805 | A1 | 2/2006 | Fang et al. |
| 2006/0127358 | A1 | 6/2006 | Muzyczka et al. |
| 2006/0188484 | A1 | 8/2006 | Rabinowitz et al. |
| 2007/0036760 | A1 | 2/2007 | Wilson et al. |
| 2007/0196275 | A1 | 8/2007 | Li et al. |
| 2008/0269149 | A1 | 10/2008 | Bowles et al. |
| 2009/0075357 | A1 | 3/2009 | Snyder |
| 2009/0197338 | A1 | 8/2009 | Vandenberghe et al. |
| 2009/0286321 | A1 | 11/2009 | Warrington et al. |
| 2012/0009268 | A1 | 1/2012 | Asokan et al. |
| 2013/0109742 | A1 | 5/2013 | Hewitt et al. |
| 2014/0005249 | A1 | 1/2014 | Hugnot et al. |

(Continued)

FOREIGN PATENT DOCUMENTS

| | | |
|---|---|---|
| EP | 1486567 A1 | 12/2004 |
| EP | 1 487 501 B1 | 12/2012 |

(Continued)

OTHER PUBLICATIONS

La Bella T, Bertin B, Mihaljevic A, et al. Predictive power of deleterious single amino acid changes to infer on AAV2 and AAV2-13 capsids fitness. 2024., Mol Ther Methods Clin Dev. 2024;32(3):101327., doi: 10.1016/j.omtm.2024.101327 (Year: 2024).*

(Continued)

*Primary Examiner* — Maria G Leavitt
*Assistant Examiner* — Kodye Lee Abbott
(74) *Attorney, Agent, or Firm* — Wolf, Greenfield & Sacks, P.C.

(57) ABSTRACT

Described herein are AAV particles having capsid proteins with amino acid substitutions that confer increased affinity for and transduction of glioma cells. The disclosed capsid proteins may be used in conjunction with any therapeutic transgene for treatment of cancer, including in the manufacture of an AAV particle. Also described are methods of identifying AAV variants having increased affinity for and transduction of specific tumor cell types.

10 Claims, 11 Drawing Sheets

Specification includes a Sequence Listing.

(56) References Cited

U.S. PATENT DOCUMENTS

| | | |
|---|---|---|
| 2014/0134168 A1 | 5/2014 | Zurawski et al. |
| 2014/0227268 A1 | 8/2014 | Banchereau et al. |
| 2014/0341852 A1 | 11/2014 | Srivastava et al. |
| 2015/0024036 A1 | 1/2015 | Saydam et al. |
| 2016/0017005 A1 | 1/2016 | Asokan et al. |
| 2016/0074389 A1 | 3/2016 | Lisanto |
| 2016/0116474 A1 | 4/2016 | Suva et al. |
| 2016/0289275 A1 | 10/2016 | Chiorini et al. |
| 2016/0369298 A1 | 12/2016 | Marsic et al. |
| 2016/0369299 A1 | 12/2016 | Boye et al. |
| 2017/0051288 A1 | 2/2017 | Byrne et al. |
| 2018/0015172 A1 | 1/2018 | Muzyczka et al. |
| 2018/0066285 A1 | 3/2018 | Ojala et al. |
| 2018/0193489 A1 | 7/2018 | Hobbs et al. |
| 2018/0244727 A1 | 8/2018 | Zhong et al. |
| 2018/0245098 A1 | 8/2018 | Yazicioglu et al. |
| 2019/0048041 A1 | 2/2019 | Asokan et al. |
| 2019/0127424 A1 | 5/2019 | Srivastava et al. |
| 2019/0249195 A1 | 8/2019 | Marsic et al. |
| 2019/0382452 A1 | 12/2019 | Samulski et al. |
| 2020/0002386 A1 | 1/2020 | Zolotukhin et al. |
| 2020/0165614 A1 | 5/2020 | Tran et al. |
| 2020/0181644 A1 | 6/2020 | Zolotukhin et al. |
| 2021/0061863 A1 | 3/2021 | Zolotukhin et al. |
| 2021/0290771 A1 | 9/2021 | Muzyczka et al. |
| 2022/0135971 A1 | 5/2022 | Tran et al. |
| 2022/0267383 A1 | 8/2022 | Zolotukhin et al. |

FOREIGN PATENT DOCUMENTS

| | | |
|---|---|---|
| EP | 3118306 A1 | 1/2017 |
| JP | 2008-523813 A | 7/2008 |
| JP | 2016-520311 A | 7/2016 |
| JP | 2016-533709 A | 11/2016 |
| WO | WO 2004/096826 A2 | 11/2004 |
| WO | WO 2004/112727 A2 | 12/2004 |
| WO | WO 2005/028675 A2 | 3/2005 |
| WO | WO 2005/033321 A2 | 4/2005 |
| WO | WO 2007/089632 A2 | 8/2007 |
| WO | WO 2008/124724 A1 | 10/2008 |
| WO | WO 2010/011404 A2 | 1/2010 |
| WO | WO 2010/093784 A2 | 8/2010 |
| WO | WO 2010/108126 A2 | 9/2010 |
| WO | WO 2012/057363 A1 | 5/2012 |
| WO | WO 2012/109570 A1 | 8/2012 |
| WO | WO 2013/170078 A1 | 11/2013 |
| WO | WO 2013/188813 A2 | 12/2013 |
| WO | WO 2014/062454 A1 | 4/2014 |
| WO | WO 2014/193716 A2 | 12/2014 |
| WO | WO 2015/048534 A1 | 4/2015 |
| WO | WO 2015/108610 A1 | 7/2015 |
| WO | WO 2015/121501 A1 | 8/2015 |
| WO | WO 2015/134643 A1 | 9/2015 |
| WO | WO 2017/032869 A1 | 3/2017 |
| WO | WO 2017/070476 A2 | 4/2017 |
| WO | WO 2018/069891 A2 | 4/2018 |
| WO | WO 2018/211409 A1 | 11/2018 |

OTHER PUBLICATIONS

Schmit, Pauline F et al. "Cross-Packaging and Capsid Mosaic Formation in Multiplexed AAV Libraries." Molecular therapy. Methods & clinical development vol. 17 107-121. Nov. 26, 2019, doi:10.1016/j.omtm.2019.11.014 (Year: 2019).*

(Unitprot, UniProtKB/TrEMB entry Q6JC12_9VIRU, 2007) (Year: 2007).*

Amberger et al., Spreading and migration of human glioma and rat C6 cells on central nervous system myelin in vitro is correlated with tumor malignancy and involves a metalloproteolytic activity. Cancer Res. Jan. 1, 1998;58(1):149-58.

Burger et al., Recombinant AAV viral vectors pseudotyped with viral capsids from serotypes 1, 2, and 5 display differential efficiency and cell tropism after delivery to different regions of the central nervous system. Mol Ther. Aug. 2004;10(2):302-17. doi: 10.1016/j.ymthe.2004.05.024.

Chelban et al., Mutations in NKX6-2 Cause Progressive Spastic Ataxia and Hypomyelination. Am J Hum Genet. Jun. 1, 2017;100(6):969-977. doi: 10.1016/j.ajhg.2017.05.009.

Dalkara et al., In vivo-directed evolution of a new adeno-associated virus for therapeutic outer retinal gene delivery from the vitreous. Sci Transl Med. Jun. 12, 2013;5(189):189ra76. doi: 10.1126/scitranslmed.3005708.

Dmitrenko et al., Determination of molecular glioblastoma subclasses on the basis of analysis of gene expression. Cytology and genetics. Nov. 2014;48:383-91.

Fontanet et al., Pea3 Transcription Factors, Etv4 and Etv5, Are Required for Proper Hippocampal Dendrite Development and Plasticity. Cereb Cortex. Jan. 1, 2018;28(1):236-249. doi: 10.1093/cercor/bhw372.

Huang et al., Microarray analysis of the hypoxia-induced gene expression profile in malignant C6 glioma cells. Asian Pac J Cancer Prev. 2012;13(9):4793-9. doi: 10.7314/apjcp.2012.13.9.4793.

Kanaan et al., Rationally Engineered AAV Capsids Improve Transduction and Volumetric Spread in the CNS. Mol Ther Nucleic Acids. Sep. 15, 2017;8:184-197. doi: 10.1016/j.omtn.2017.06.011. Epub Jun. 21, 2017.

Muraguchi et al., NKX2.2 suppresses self-renewal of glioma-initiating cells. Cancer Res. Feb. 1, 2011;71(3):1135-45. doi: 10.1158/0008-5472.CAN-10-2304. +A56:N56.

Neuner-Jehle et al., Characterization and sleep deprivation-induced expression modulation of dendrin, a novel dendritic protein in rat brain neurons. J Neurosci Res. Oct. 15, 1996;46(2):138-51. doi: 10.1002/(SICI)1097-4547(19961015)46:2<138::AID-JNR2>3.0. CO;2-I.

Sebastian et al., Abstract 4072: Direct transdifferentiation of glioblastoma cells to antigen-presenting cells: A novel immunotherapeutic approach, Cancer Research, American Association for Cancer Research, Apr. 14, 2018 (Apr. 14, 2018), pp. 1-4, XP55969302, Retrieved from the Internet: URL:https://aacrjournals.org/cancerres/article/78/13Supplement/4072/628678/Abstract-4072-Direct-transdifferentiation-of [retrieved on Oct. 10, 2022].

Sirek et al., Insulin stimulates the expression of carbohydrate response element binding protein (ChREBP) by attenuating the repressive effect of Pit-1, Oct-1/Oct-2, and Unc-86 homeodomain protein octamer transcription factor-1. Endocrinology. Aug. 2009;150(8):3483-92. doi: 10.1210/en.2008-1702. Epub Apr. 9, 2009.

Sunayama et al., Crosstalk between the PI3K/mTOR and MEK/ERK pathways involved in the maintenance of self-renewal and tumorigenicity of glioblastoma stem-like cells. Stem Cells. Nov. 2010;28(11):1930-9. doi: 10.1002/stem.521.

Vastrad et al., Molecular mechanisms underlying gliomas and glioblastoma pathogenesis revealed by bioinformatics analysis of microarray data. Med Oncol. Sep. 26, 2017;34(11):182. doi: 10.1007/s12032-017-1043-x.

Wick et al., Phase III study of enzastaurin compared with lomustine in the treatment of recurrent intracranial glioblastoma. J Clin Oncol. Mar. 1, 2010;28(7):1168-74. doi: 10.1200/JCO.2009.23.2595. Epub Feb. 1, 2010.

Invitation to Pay Additional Fees for Application No. PCT/US2020/045526 mailed Nov. 16, 2020.

International Search Report and Written Opinion for Application No. PCT/US2020/45526 mailed Feb. 8, 2021.

International Preliminary Report on Patentability for International Application No. PCT/US2020/045526, mailed Feb. 17, 2022.

Andersen, Jimena. Study of Ascl1 Function In The Neurogenic Lineage Of The Adult Mouse Hippocampus, Division of Molecular Neurobiology, MRC National Institute for Medical Research, Mar. 2015, pp. 1-212. [Retrieved from the Internet Feb. 5, 2020] <http://discovery.ucl.ac.uk/1469969/1/PhD%20thesis_Jimena%20Andersen_Reduced.pdf>.

Appleyard et al., Pretreatment with the probiotic VSL#3 delays transition from inflammation to dysplasia in a rat model of colitis-

(56)        References Cited

OTHER PUBLICATIONS associated cancer. Am J Physiol Gastrointest Liver Physiol. Dec. 2011;301(6):G1004-13. doi: 10.1152/ajpgi.00167.2011. Epub Sep. 8, 2011.

Aslanidi et al., High-efficiency transduction of human monocyte-derived dendritic cells by capsid-modified recombinant AAV2 vectors. Vaccine. Jun. 6, 2012;30(26):3908-17. doi: 10.1016/j.vaccine. 2012.03.079. Epub Apr. 10, 2012. Author Manuscript, 23 pages.

Aslanidi et al., Optimization of the capsid of recombinant adeno-associated virus 2 (AAV2) vectors: the final threshold? PLoS One. 2013;8(3):e59142. doi: 10.1371/journal.pone.0059142. Epub Mar. 19, 2013.

Aydemir et al., Mutants at the 2-Fold Interface of Adeno-associated Virus Type 2 (AAV2) Structural Proteins Suggest a Role in Viral Transcription for AAV Capsids. J Virol. Jul. 27, 2016;90(16):7196-7204. doi: 10.1128/JVI.00493-16.

Bowles et al., Phase 1 gene therapy for Duchenne muscular dystrophy using a translational optimized AAV vector. Mol Ther. Feb. 2012;20(2):443-55. doi: 10.1038/mt.2011.237. Epub Nov. 8, 2011.

Bozzetti et al., Metabolic Bone Disease in preterm newborn: an update on nutritional issues. Ital J Pediatr. Jul. 14, 2009;35(1):20. doi: 10.1186/1824-7288-35-20.

Choudhury et al., Novel Methodology for Creating Macaque Retinas with Sortable Photoreceptors and Ganglion Cells. Front Neurosci. Dec. 1, 2016;10:551. eCollection 2016.

Clavairoly, Adrien. Ascll and Olig2 Transcriptional Regulations of Oligodendrogenesis, Neurons and Cognition [q-bio.NC], Université Pierre et Marie Curie, Paris VI, (2014), (257 pages), English, NNT: 2014PA066316. [Retrieved from the Internet Feb. 5, 2020] <https://tel.archives-ouvertes.fr/tel-01133659/file/2014PA066316.pdf>.

Crommentuijin et al., Systemically administered AAV9-sTRAIL combats invasive glioblastoma in a patient-derived orthotopic xenograft model. Mol Ther Oncolytics. Jun. 22, 2016;3:16017. doi: 10.1038/mto.2016.17.

Galindo, Alkaline Phosphatase (ALP). Aug. 23, 2010. Retrieved on May 8, 2018. http://www.isu.edu/~galisusa/alp_sop.html. 4 pages.

Gao et al., Novel adeno-associated viruses from rhesus monkeys as vectors for human gene therapy. Proc Natl Acad Sci U S A. Sep. 3, 2002;99(18):11854-9. Epub Aug. 21, 2002.

Gao et al., Clades of Adeno-associated viruses are widely disseminated in human tissues. J Virol. Jun. 2004;78(12):6381-8.

Genbank Submission; NIH/NCBI, Accesion No. AAS99272.1. Gao et al., Jun. 24, 2004.

Grimm et al., E Pluribus Unum: 50 Years of Research, Millions of Viruses, and One Goal—Tailored Acceleration of AAV Evolution. Mol Ther. Dec. 2015;23(12):1819-31.

Guhasarkar et al., Systemic AAV9-IFNβ gene delivery treats highly invasive glioblastoma. Neuro Oncol. Nov. 2016;18(11):1508-1518. doi: 10.1093/neuonc/now097. Epub May 18, 2016.

Guo et al., Protein tolerance to random amino acid change. PNAS. Jun. 22, 2004;101(25):9205-10.

Gurda et al., Capsid antibodies to different adeno-associated virus serotypes bind common regions. J Virol. Aug. 2013;87(16):9111-24. doi: 10.1128/JVI.00622-13. Epub Jun. 12, 2013.

Haapa-Paananen et al., HES6 gene is selectively overexpressed in glioma and represents an important transcriptional regulator of glioma proliferation. Oncogene. Mar. 8, 2012;31(10):1299-310. doi: 10.1038/onc.2011.316. Epub Jul. 25, 2011.

Hoffmann et al., Stem Cell Factor Sox2 and Its Close Relative Sox3 Have Differentiation Functions In Oligodendrocytes, The Company of Biologists Ltd. I Development, vol. 141, (2014), pp. 39-50. DOI: 10.1242/dev.098418. [Retrieved from the Internet Feb. 5, 2020] <https://dev.biologists.org/content/develop/141/1/39.full.pdf>.

Johansson, Térèse A. et al. Identification of Achaete-Scute Complex-Like 1 (ASCL1) Target Genes and Evaluation of DKK1 and TPH1 Expression In Pancreatic Endocrine Tumours, BMC Cancer, BioMed Central, vol. 9, No. 1, Sep. 10, 2009, pp. 1-13. XP021057699. ISSN: 1471-2407. DOI: 10.1186/1471-2407-9-321. [Retrieved from the Internet Feb. 5, 2020] <https://bmccancer.biomedcentral.com/articles/10.1186/1471-2407-9-321>.

Klimczak, Molecular evolution of adeno-associated virus for improved retinal gene therapies. University of California, Berkeley. Jan. 1, 2010. Retrieved from the internet <https://digitalassets.lib.berkeley.edu/etd/ucb/text/Klimczak_berkeley_0028E_10444.pdf> 116 pages.

Koerber et al., DNA shuffling of adeno-associated virus yields functionally diverse viral progeny. Mol Ther. Oct. 2008;16(10):1703-9. doi: 10.1038/mt.2008.167. Epub Aug. 26, 2008. Author Manuscript, 17 pages.

Lan et al., IA-2, a transmembrane protein of the protein tyrosine phosphatase family, is a major autoantigen in insulin-dependent diabetes mellitus. Proc Natl Acad Sci U S A. Jun. 25, 1996;93(13):6367-70.

Lerch et al., The structure of adeno-associated virus serotype 3B (AAV-3B): insights into receptor binding and immune evasion. Virology. Jul. 20, 2010;403(1):26-36. doi: 10.1016/j.virol.2010.03.027. Epub May 4, 2010.

Lochrie et al., Mutations on the external surfaces of adeno-associated virus type 2 capsids that affect transduction and neutralization. J Virol. Jan. 2006;80(2):821-34. doi: 10.1128/JVI.80.2.821-834.2006.

Maersch et al., Optimization of stealth adeno-associated virus vectors by randomization of immunogenic epitopes. Virology. Feb. 5, 2010;397(1):167-75. doi: 10.1016/j.virol.2009.10.021. Epub Nov. 18, 2009.

Maguire et al., Directed evolution of adeno-associated virus for glioma cell transduction. J Neurooncol. Feb. 2010;96(3):337-47. doi: 10.1007/s11060-009-9972-7. Epub Jul. 19, 2009. Author Manuscript, 16 pages.

Maheshri et al., Directed evolution of adeno-associated virus yields enhanced gene delivery vectors. Nat Biotechnol. Feb. 2006;24(2):198-204. doi: 10.1038/nbt1182. Epub Jan. 22, 2006.

Marsic et al., Vector design Tour de Force: integrating combinatorial and rational approaches to derive novel adeno-associated virus variants. Mol Ther. Nov. 2014;22(11):1900-9. doi: 10.1038/mt.2014.139. Epub Jul. 22, 2014.

Méndez-Gómez et al., Transcytosis in the blood-cerebrospinal fluid barrier of the mouse brain with an engineered receptor/ligand system. Mol Ther Methods Clin Dev. Oct. 7, 2015;2:15037. doi: 10.1038/mtm.2015.37. eCollection 2015.

Muramatsu et al., Nucleotide sequencing and generation of an infectious clone of adeno-associated virus 3. Virology. Jul. 1, 1996;221(1):208-17.

Opie et al., Identification of amino acid residues in the capsid proteins of adeno-associated virus type 2 that contribute to heparan sulfate proteoglycan binding. J Virol. Jun. 2003;77(12):6995-7006.

Ozawa, [Gene therapy using AAV]. Uirusu. Jun. 2007;57(1):47-55. Article in Japanese.

Pang et al., AAV-mediated cone rescue in a naturally occurring mouse model of CNGA3-achromatopsia. PLoS One. 2012;7(4):e35250. doi: 10.1371/journal.pone.0035250. Epub Apr. 11, 2012.

Perabo et al., Combinatorial engineering of a gene therapy vector: directed evolution of adeno-associated virus. J Gene Med. Feb. 2006;8(2):155-62.

Rheinbay et al., An aberrant transcription factor network essential for Wnt signaling and stem cell maintenance in glioblastoma. Cell Rep. May 30, 2013;3(5):1567-79. doi: 10.1016/j.celrep.2013.04.021. Epub May 23, 2013. Author Manuscript, 27 pages.

Romero et al., Exploring protein fitness landscapes by directed evolution. Nat Rev Mol Cell Biol. Dec. 2009;10(12):866-76. Author Manuscript, 25 pages.

Santiago-Ortiz Set al., Adeno-associated virus (AAV) vectors in cancer gene therapy. J Control Release. Oct. 28, 2016;240:287-301. doi: 10.1016/j.jconrel.2016.01.001. Epub Jan. 12, 2016. Author Manuscript, 39 pages.

Shannon et al., ID of Optimal Gene Delivery Vectors in Primate Retina for Treatment of Human Disorders: Labels Non-Human Primate Eyes with Fluorescent Proteins and/or Fluorescent Dyes, Creating Sortable Cell Populations, Allowing for Screening of Capsid and Promoter Libraries. Office of Technology Licensing, University of Florida. Feb. 11, 2017. Retrieved from the Internet: http://technologylicensing.research.ufl.edu/technologies/16134.pdf> on Apr. 12, 2017. 4 pages.

(56)  References Cited

OTHER PUBLICATIONS

Suvà, Mario L. et al. Reconstructing and Reprogramming The Tumor-Propagating Potential of Glioblastoma Stem-Like Cells, Cell Press, vol. 157, No. 3, Apr. 24, 2014, pp. 580-594. [Retrieved from the Internet Feb. 5, 2020] <https://www.sciencedirect.com/science/article/pii/S0092867414002293>.

Swartling, Fredrik J. Myc Proteins In Brain Tumor Development and Maintenance, Upsula Journal of Medical Sciences, vol. 117, No. 2, Feb. 2012, pp. 122-131. ISSN: 0300-9734. DOI: 10.3109/03009734.2012.658975. [Retrieved from the Internet Feb. 5, 2020] <https://www.tandfonline.com/doi/full/10.3109/03009734.2012.658975>.

Tseng et al., Mapping the AAV Capsid Host Antibody Response toward the Development of Second Generation Gene Delivery Vectors. Front Immunol. Jan. 30, 2014;5:9. doi: 10.3389/fimmu.2014.00009. eCollection 2014.

Wu et al., Mutational analysis of the adeno-associated virus type 2 (AAV2) capsid gene and construction of AAV2 vectors with altered tropism. J Virol. Sep. 2000;74(18):8635-47. doi: 10.1128/jvi.74.

Xie et al., The atomic structure of adeno-associated virus (AAV-2), a vector for human gene therapy. Proc Natl Acad Sci U S A. Aug. 6, 2002;99(16):10405-10. doi: 10.1073/pnas.162250899. Epub Jul. 22, 2002.

Zhong et al., Next generation of adeno-associated virus 2 vectors: point mutations in tyrosines lead to high-efficiency transduction at lower doses. Proc Natl Acad Sci U S A. Jun. 3, 2008;105(22):7827-32. doi: 10.1073/pnas.0802866105. Epub May 29, 2008. Erratum in Proc Natl Acad Sci U S A. Aug. 5, 2008;105(31):11032.

Zolotukhin et al., Improved Adeno-associated Viral Gene Transfer to Murine Glioma. J Genet Syndr Gene Ther. Apr. 29, 2013;4(133):12815. doi: 10.4172/2157-7412.

U.S. Appl. No. 17/009,536, filed Sep. 1, 2020, Zolotukhin et al.

U.S. Appl. No. 17/689,324, filed Mar. 8, 2022, Zolotukhin et al.

U.S. Appl. No. 17/228,298, filed Apr. 12, 2021, Muzyczka et al.

U.S. Appl. No. 16/613,402, filed Nov. 18, 2019, Tran et al.

U.S. Appl. No. 17/428,722, filed Aug. 5, 2021, Tran et al.

PCT/US2020/045526, Nov. 16, 2020, Invitation to Pay Additional Fees.

PCT/US2020/45526, Feb. 8, 2021, International Search Report and Written Opinion.

PCT/US2020/045526, Feb. 17, 2022, International Preliminary Report on Patentability.

Berezovsky et al., Sox2 promotes malignancy in glioblastoma by regulating plasticity and astrocytic differentiation. Neoplasia. Mar. 2014;16(3):193-206, 206.e19-25. doi: 10.1016/j.neo.2014.03.006. Epub Apr. 13, 2014.

Goyal et al., Engineering a prokaryotic Cys-loop receptor with a third functional domain. J Biol Chem. Oct. 7, 2011;286(40):34635-42. doi: 10.1074/jbc.M111.269647. Epub Aug. 15, 2011.

Kleine et al., Immune surveillance of the human central nervous system (CNS): different migration pathways of immune cells through the blood-brain barrier and blood-cerebrospinal fluid barrier in healthy persons. Cytometry A. Mar. 2006;69(3):147-51. doi: 10.1002/cyto.a.20225.

Kügler et al., Differential transgene expression in brain cells in vivo and in vitro from AAV-2 vectors with small transcriptional control units. Virology. Jun. 20, 2003;311(1):89-95. doi: 10.1016/s0042-6822(03)00162-4.

Schultz et al., Recombinant adeno-associated virus transduction and integration. Mol Ther. Jul. 2008;16(7):1189-99. doi: 10.1038/mt.2008.103. Epub May 20, 2008.

Tan et al., Selective and quickly reversible inactivation of mammalian neurons in vivo using the Drosophila allatostatin receptor. Neuron. Jul. 20, 2006;51(2):157-70. doi: 10.1016/j.neuron.2006.06.018.

Weins et al., Dendrin ablation prolongs life span by delaying kidney failure. Am J Pathol. Aug. 2015; 185(8):2143-57. doi: 10.1016/j.ajpath.2015.04.011. Epub Jun. 12, 2015.

Zolotukhin et al., Recombinant adeno-associated virus purification using novel methods improves infectious titer and yield. Gene Ther. Jun. 1999;6(6):973-85. doi: 10.1038/sj.gt.3300938.

* cited by examiner

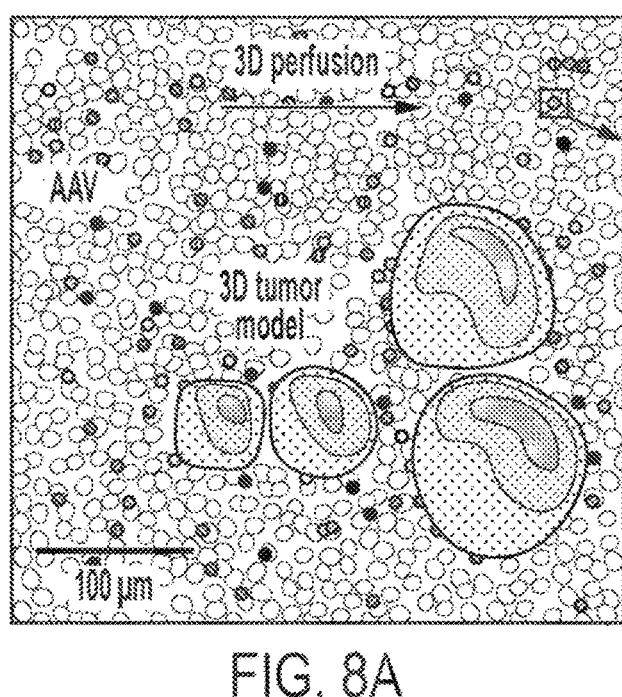
FIG. 8A
FIG. 8B
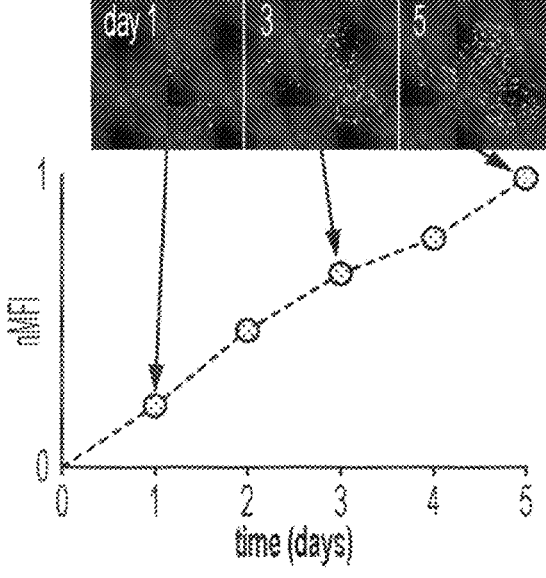
FIG. 8C
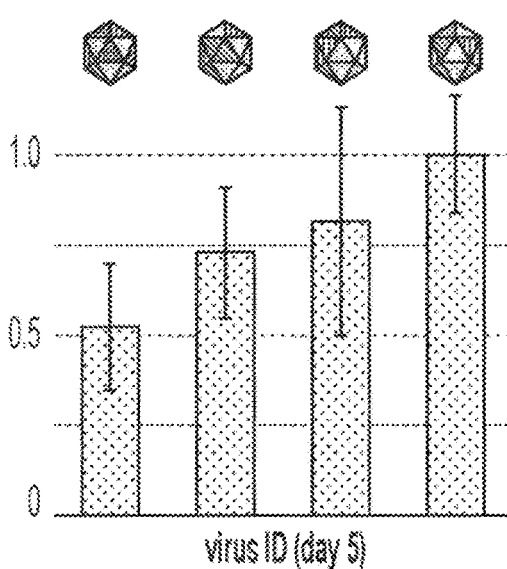
FIG. 8D

AAV CAPSID VARIANTS FOR TARGETING HUMAN GLIOBLASTOMA CELLS

RELATED APPLICATIONS

This application is a national stage filing under 35 U.S.C. § 371 of International Patent Application Serial No. PCT/US2020/045526, filed Aug. 7, 2020, which claims the benefit under 35 U.S.C. § 119 (e) of the filing date of U.S. Provisional Application Ser. No. 62/884,716, filed Aug. 9, 2019. The contents of the above-referenced applications are incorporated herein in their entirety by reference.

GOVERNMENT SUPPORT

This invention was made with government support under grant number CA228875 awarded by the National Institutes of Health. The government has certain rights in the invention.

REFERENCE TO A SEQUENCE LISTING SUBMITTED AS A TEXT FILE VIA EFS-WEB

This application contains a Sequence Listing which has been submitted in ASCII format via EFS-Web and is hereby incorporated by reference in its entirety. Said ASCII copy, created on Feb. 7, 2022, is named U119670041US01-SEQ-EPG and is 20,759,730 bytes in size.

BACKGROUND OF THE INVENTION

Adeno-associated virus (AAV) is a small (20 nm) replication-defective, non-enveloped virus. AAV can infect non-dividing cells and has the ability to stably integrate into the host cell genome. Because AAV is generally non-pathogenic, it is an attractive tool for delivering genes to cells in vivo. Several serotypes of naturally occurring and artificial AAVs having different affinities for different cells in vivo are known. These serotypes are determined by the AAV capsid proteins. AAV contains three capsid proteins, VP1, VP2 and VP3 (87, 72 and 62 kilodaltons, respectively) typically present in a ratio of about 1:1:10. While different AAV serotypes have particular organ tropisms that can be taken advantage of to target gene-based therapies to a target organ (see e.g., Surace et al., *Vision Res.* 2008, 48(3):353-9; Zincarelli et al., *Mol Ther.* 2008, 16(6):1073-80), the increased efficiency in AAV for targeting certain organs or tissues would be of great benefit. An example of such tissue or cell type is glioma.

SUMMARY OF THE INVENTION

Provided herein are viral vectors, and in particular recombinant AAV (rAAV) vectors, for treatment of cancers such as glioblastoma. Further provided herein are novel rAAV capsid protein variants that exhibit improved transduction of glioblastoma, glioma, glioblastoma stem-like cells (GSC) and glioma stem-like cells. The disclosed capsid variants may be used in conjunction with any therapeutic transgene in the manufacture of an AAV particle for treatment of cancer. Accordingly, the disclosure provides rAAV particles, compositions comprising rAAV particles, and methods for treatment of cancer in a subject suffering from or diagnosed with glioblastoma or glioma. Further provided herein are methods of identifying AAV variants having increased affinity for and transduction of specific tumor cell type.

Further disclosed herein are methods for generating rAAV capsids having enhanced tumor cell-type specific binding. In some aspects, these methods comprise multiple iterations of evolution, such as in directed evolution screening. In some aspects, the methods comprise generating a library of rAAV capsid variants. The methods comprise use of a dynamic mode of administration of an AAV library reagent. Delivery of the AAV library may be at least partially synchronized with tumor progression in a subject tumor, such as a mouse model tumor.

Accordingly, in some aspects, an AAV library containing different cap proteins is administered to a mouse harboring a tumor. The tumor may either be implanted (such as by injection of tumor cells), arise spontaneously, or be induced. The AAV library may be administered to the tumor by infusion. As the tumor develops and grows, the level of infusion is increased. In some embodiments, the intratumoral infusion of the AAV library is continuous. Initially, the infusion rate is slow. As the tumor grows, the infusion rates synchronized with early and late stage of tumor growth. By synchronizing intratumoral infusion rate of the AAV library with early and late stage of tumor growth, a nearly 10-fold increase in AAV binding to the tumor cell and gene delivery may be observed when compared to a single intratumor injection.

Glioma is a tumor of the glial cells in the brain and spinal cord. Three types of glial cells can produce tumors. Gliomas are classified according to the type of glial cell involved in the tumor, as well as the tumor's genetic features, which can help predict how the tumor will behave over time and the treatments most likely to work. The types of glioma include astrocytomas (tumors of astrocytes), which includes astrocytoma, anaplastic astrocytoma and glioblastoma multiforme (GBM); ependymoma; and oligodendroglioma. Inherited polymorphisms of DNA repair genes ERCC1, ERCC2 (XPD) and XRCC1 increase the risk of glioma. Surgical procedures are often the preferred initial treatments for gliomas. GBM is the most aggressive form of astrocytoma. In adults, GBM occurs most often in the cerebral hemispheres, especially in the frontal and temporal lobes of the brain. GBM is a devastating cancer that typically results in death in the first 15 months after diagnosis.

The current standard of care including surgical resection, adjuvant chemotherapy, and radiation does not result in remission for the majority of patients. Recently, gene therapy and immunotherapy approaches for treating glioma and glioblastoma have been developed. However, gene therapy treatments that have reached clinical trials for glioblastoma have failed. In particular, viral vector-based treatments have not achieved FDA approval due to issues with viral delivery, inefficient tumor penetration, and limited efficacy. There remains a need in the art for viral vector-based constructs for gene delivery to specific cell types, such as tumor cells.

This disclosure is based, at least in part, on the identification of variant AAV capsid proteins and particles comprising the variant capsid proteins that show a tropism for transducing glioma, in some embodiments, to a greater extent compared to wild-type AAV (such as rAAV2) particles comprising wild-type capsid proteins. Identification of variant rAAV proteins disclosed herein was based on in vivo screening of a rAAV2 capsid library containing capsid variants with amino acid substitutions or mutations in the capsid proteins of AAV2 in a mouse model.

As disclosed in the Examples provided herein, synchronized delivery of an AAV library reagent in a directed evolution screening for variants specific for slow or fast cycling glioblastoma stem-like cell (GSC) populations resulted in infection of target cells. And synchronized delivery of an AAV library reagent in a directed evolution screening for variants specific for glioblastoma multiforme (GBM) populations resulted in infection of target cells. Accordingly, the disclosure provides methods of synchronized delivery of an AAV library reagent in screening for variants specific for GBM cells and for GSC cells.

Described are rAAV capsid variants having increase specificity for binding and/or transduction of GBM and GSC. The variants, or altered capsid proteins, may contain amino acid substitutions in the regions corresponding to amino acids 263-267, amino acids 444-461, amino acids 490-507, amino acids 527-532, amino acids 545-556, and amino acids 585-596, of the wild-type AAV2 VP1 amino acid sequence, or amino acid substitutions in corresponding positions of other wild-type serotype VP1 sequences (such as AAV5, AAV8, and AAV9).

In some aspects, the disclosed rAAV capsids and particles comprising these capsids have increased recognition and/or binding to certain cell markers, such as cell markers associated with glioblastoma or glioma. Without being bound to any theory, the increased recognition may confer improved binding to and transduction of tumor cells that exhibit these cell markers. This improved binding and transduction may lead to increased therapeutic effects in these cells, including the suppression of growth or death of such cells. These cell markers may comprise glycoproteins. In some embodiments, the cell markers comprise CD133 and CD44. In some embodiments, AAV particles having increased recognition of CD133+ GSC cells, CD44+ GSC cells, CD44+/CD133+ GSC cells, and CD44−/CD133− GBM cells are described. Amino acid substitutions in the AAV capsid proteins that may contribute to or confer an increase in specificity for transduction of GSC and/or GBM are shown in Tables 1-9.

In some embodiments, the disclosure provides rAAV capsids and viral particles for transducing glioblastoma cells (GBM) and/or glioma stem-like cells (GSC) comprising a capsid protein comprising the amino acid substitutions as described in any of Table 1, Table 2, Table 3, Table 4, Table 5, Table 6, Table 7, Table 8, or Table 9. In some embodiments, the capsid protein of any of the disclosed particles comprises substitutions at one of the following combinations of amino acid positions:

(a) Q263, S264, Y444, T450, P451, S452, T454, Q457, R459, Q461, S492, A493, D494, E499, and Y500F, or (b) E531, K532, S547, E548, D553, R585, and R588;

of the amino acid sequence of wild-type AAV2 VP1 capsid (SEQ ID NO: 1), or homologous amino acid positions of a wild-type VP1 capsid sequence of an AAV serotype other than AAV2. The capsis may further comprise substitutions at E530, E531, and K532 of a wild-type AAV2 VP1 capsid sequence as set forth in SEQ ID NO: 1.

The amino acid substitutions of any of these rAAV capsids particles may comprise one or more of Q263G, S264T, Y444F, T450A, P451E, S452G, T454L, T455K, Q457M, R459H, Q461L, S492D, A493G, D494E, E499D, and Y500F relative to the amino acid sequence of AAV2 VP1 capsid (SEQ ID NO: 1), or homologous amino acids of a wild-type VP1 capsid sequence of an AAV serotype other than AAV2.

In some aspects, the disclosure further provides methods of identifying rAAV variants having affinity for a tumor cell type comprising providing a continuous intratumor graded infusion of a viral vector library into a tumor. In some embodiments, the rate of infusion is proportional to the rate of tumor growth.

In some aspects, provided herein are compositions and methods of treatment comprising administering any of the described rAAV particle compositions to a subject in need thereof. In some embodiments, the subject is a mammalian subject, such as a human subject.

BRIEF DESCRIPTION OF THE DRAWINGS

The following drawings form part of the present specification and are included to further demonstrate certain aspects of the present disclosure, which can be better understood by reference to one or more of these drawings in combination with the detailed description of specific embodiments presented herein. It is to be understood that the data illustrated in the drawings in no way limit the scope of the disclosure.

FIG. 8A. Diagram of a 3D perfused neurosphere formation assay for AAV screen and validation, in accordance with the Examples.

FIG. 8B. Diagram of AAV perfusion (passage) between microgel (PEG μgel) particles.

FIG. 8C. Kinetics of AAV transduction using Mutant #9 in the original DE screen. Mutant #9 is engineered to express Antares. Fluorescence in cells is measured in nMFI.

FIG. 8D. Ranking of GBM tropism of the top 4 GBM-specific AAV2 mutants selected in the original DE screen.

FIG. 9A: AAV2 Mutant 9 (evaluated in the original DE screen) containing a GFP expression cassette with or without one of a scrambled short hairpin RNA (shRNA) (X), shRNA targeting Nkx6-2 and Ascl-1 genes (Y), and shRNA targeting Nkx6-2 alone (Z) (not shown) efficiently transduced CA7 GSC cells.

FIG. 9B: The extent of shRNA depletion of these genes, leading to increased cell death, was captured by propidium iodide (PI) uptake (darkened squares) using an expert confocal algorithm. GFP expression is indicated as lighter-

Figure 9A:
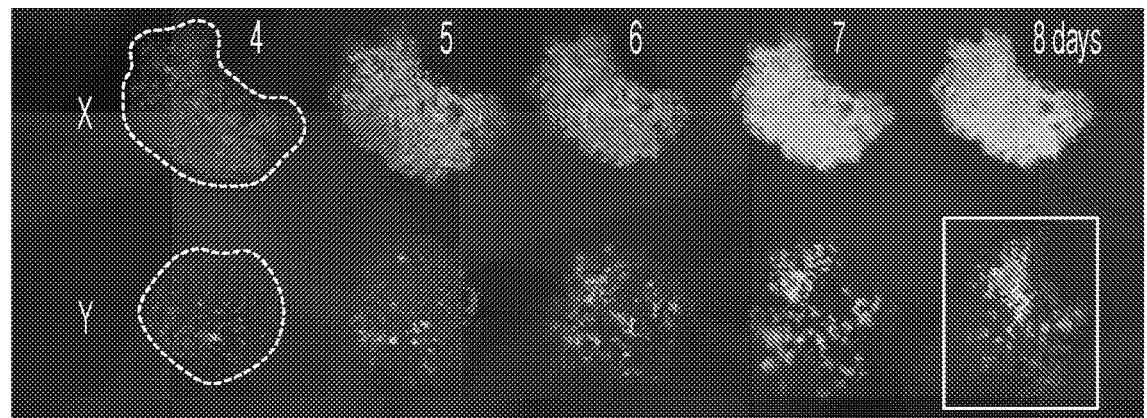
FIGS. 9A-9C. pNSA assay for AAV evaluation.
Figure 9B:
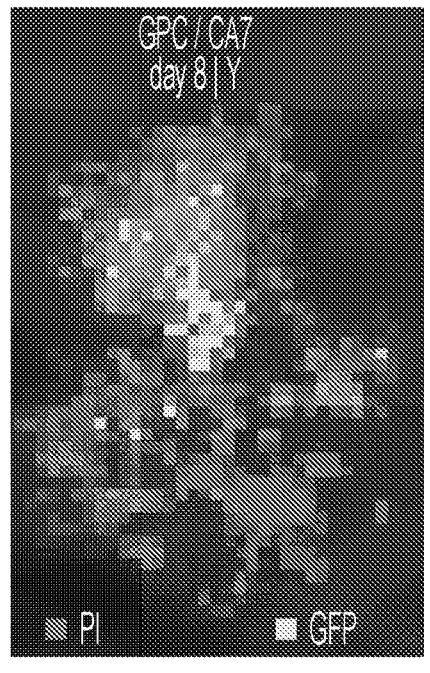
Figure 9C:
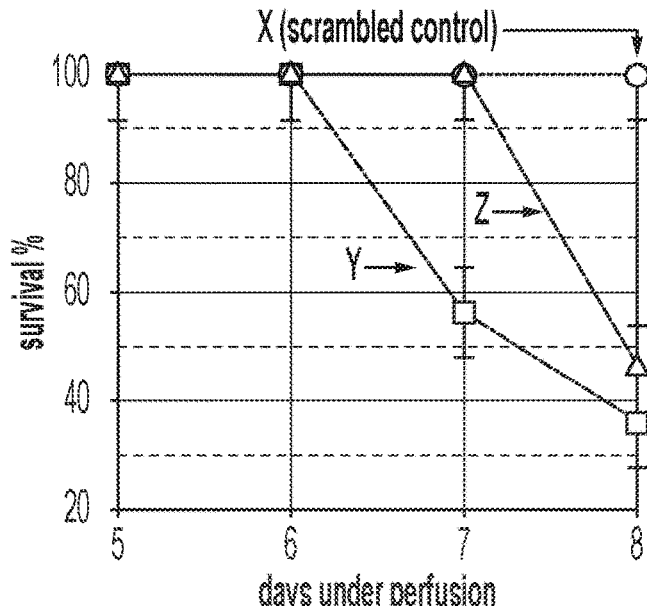

5 shaded squares. FIG. 9C is a chart that shows differential killing kinetics of the 3 shRNA as measured by pNSA, enabling dynamic screening of lead AAV variants targeting shRNA cassettes.

DETAILED DESCRIPTION

Provided herein are viral capsid protein variants that exhibit improved transduction of glioblastoma, glioma, glioblastoma stem-like cells (GSC) and glioma stem-like cells. The disclosed capsid variants may be used in conjunction with any therapeutic transgene for treatment of cancer. The disclosure provides viral particles comprising any of these capsid variants that have improved tumor penetration relative to existing viral particle treatments for tumors. The disclosure also provides viral particles that achieve improved efficacy and/or achieve equal or improved efficacy at lower vector titers (amounts) than existing viral particle treatments. In particular embodiments, the capsid protein variants are AAV variants.

Accordingly, the disclosure also provides rAAV particles and compositions comprising rAAV particles having mutant capsid proteins. The disclosure provides methods and compositions for delivering rAAV particles having mutant capsid proteins to neural tissue, such as central nervous system (CNS) tissue. In particular embodiments, methods are provided for delivery to CNS tissue such as brain tissue (e.g., human brain tissue). The disclosure further provides methods for treatment of cancer in a subject suffering from or diagnosed with glioblastoma or glioma. The disclosure further provides methods of treatment of a subject in need thereof (such as a human subject) by administering one or more of these rAAV particles or compositions. In some embodiments, these methods comprise delivering a heterologous gene or targeting construct to a glioma cell comprising inserting the heterologous gene or targeting contruct into any of the disclosed AAV particles, and contacting the glioma cell with the AAV. The step of contacting the glioma cell may comprise a single AAV particle administration or multiple AAV administrations (such as a regimen of multiple administrations). In some embodiments, any of the disclosed methods of treatment provide a reduction, either partial or complete, of a glioma tumor. In some embodiments, the disclosed methods of treatment induce apoptosis or cell death in a glioma.

Provided herein are methods of transducing GBM and GSC cells and tissue. In some embodiments, methods of transducing GBM and GSC comprise providing to the cell any one of the compositions of variant rAAV particles as disclosed herein, wherein the rAAV particles in the composition comprise a nucleic acid comprising a heterologous nucleic acid. The disclosure also provides host cells (such as mammalian cells) comprising any of these particles or compositions. In some embodiments, these host cells comprise GBM or GSC. Further provided herein are methods of identifying AAV variants having increased affinity for and transduction of specific tumor cell type.

Glioblastoma multiforme (GBM), the most common and fatal form of a primary brain tumor, accounts for approximately 60% of all glioma cases and is categorized as grade IV glioma. Local invasiveness, neoangiogenesis, and intratumor heterogeneity are among the most important hallmarks of the aggressiveness of GBM. GBM tumors contain functional subsets of cells called glioblastoma stem-like cells (GSCs), which are resistant to radiation therapy and chemotherapy and eventually lead to tumor recurrence. Recent studies showed that GSCs reside in particular tumor niches (such as perivascular niches) that are necessary to support their behavior. The presence of GSCs was first demonstrated by the identification of a CD133$^+$ cell subpopulation that is capable of tumor initiation in vivo (Singh et al., 2004). CD133, a glycoprotein cell surface marker of normal neural stem cells, is commonly used to distinguish GSCs. The percentage of CD133$^+$ cells may be significantly higher in recurrent GBMs after radiotherapy and chemotherapy as compared with primary tumors. Apart from CD133, other cell surface markers, such as SSEA-1 and CD44, have been used to enrich or distinguish stem-like populations in GBM. In particular, CD44 is highly expressed in the mesenchymal subtype of GBM, and its expression has been used to enrich for stem-like cells (Anido et al., 2010). It has been reported that Cd44$^{-/-}$ and Cd44$^{+/-}$ mice survived longer than Cd44$^{+/+}$ mice with PDGF-driven gliomas, indicating that CD44 actively contributes to aggressive glioma growth (Pietras et al., *Cell Stem Cell*. 2014). It was recently shown that patient-derived glioma stem-like cells exhibited a characteristic equilibrium of distinct CD133$^+$ and CD44$^+$ subpopulations (Brown et al., *PLoS One*. 2017; 12(2): e0172791, herein incorporated by reference). GSC populations are further characterized by their rate of growth and movement, i.e., fast-cycling (fast-dividing and fast-moving, or simply "fast") and slow-cycling (slow-dividing and slow-moving, or simply "slow") populations (see id.).

In some embodiments, the amino acid substitutions in the capsids of any of the described particles confer increased transduction of GBM or GSC compared to an AAV particle comprising a capsid protein without the substitutions (such as a wild-type capsid protein).

In some aspects, the disclosed AAV particles comprise a recombinant AAV genome (or vector) comprising a polynucleotide. This polynucleotide may encode at least one heterologous nucleic acid region. In some embodiments, the heterologous nucleic acid region encodes a peptide or protein. In certain embodiments, the heterologous nucleic acid region encodes a therapeutic peptide or protein. In certain embodiments, the heterologous nucleic acid region encodes a short hairpin RNA (shRNA). In some embodiments, the heterologous nucleic acid region encodes a short hairpin RNA targeting a gene encoding a transcription factor involved in neurogegenesis, such as a master regulator gene. In certain embodiments, the heterologous nucleic acid region encodes a short hairpin RNA targeting one or more of the Ascl-1 or Nkx6-2 genes, such as the human ASCL-1 or NKX6-2 genes. In some aspects, the therapeutic peptide or protein comprises a repair enzyme, a checkpoint inhibitor, a transcription factor, a growth factor receptor a growth factor ligand, or a tumor suppressor protein. In some embodiments, the therapeutic peptide is the repair enzyme MGMT, known to be an important prognostic indicator in GBM. Accordingly, the disclosure provides AAV particles comprising rAAV vectors encoding the enzyme MGMT.

In some embodiments, any of the described rAAV particles comprise a capsid having an amino acid sequence having at least 85%, at least 90%, at least 92.5%, at least 95%, at least 98%, or at least 95% identity to any one of SEQ ID NOs: 4-7 and 9-7010. In some embodiments, any of the described rAAV particles comprise a capsid having an amino acid sequence having at least 85%, at least 90%, at least 92.5%, at least 95%, at least 98%, or at least 95% identity to any one of SEQ ID NOs: 4-7 and 9-28. In some embodiments, any of the described rAAV particles comprise a capsid having an amino acid sequence having at least 85% or at least 90% identity to any one of SEQ ID NOs: 4-7 and 9-28. In some embodiments, any of the described rAAV particles comprise a capsid having an amino acid sequence comprising any one of SEQ ID NOs: 4-7 and 9-28. In some embodiments, any of the described rAAV particles comprise a capsid having an amino acid sequence having at least 85%, at least 90%, at least 92.5%, at least 95%, at least 98%, or at least 95% identity to any one of SEQ ID NOs: 4-7. In particular embodiments, the rAAV capsid comprises the sequence of any one of SEQ ID NOs: 4-7. In certain embodiments, the rAAV capsid comprises SEQ ID NO: 4.

In some embodiments, the disclosed capsids may comprise a sequence having 1, 2, 3, 4, 5, 6, 7, 8, 9, 10, 11, 12, 13, 14, 15, 16, 17, or 18 amino acids that differ relative to the sequence of any one of SEQ ID NOs: 4-7 and 9-28. These differences may comprise amino acids that have been inserted, deleted, or substituted relative to the sequence of any one of SEQ ID NOs: 4-7 and 9-28. In some embodiments, the disclosed capsids may comprise a sequence having 1, 2, 3, 4, 5, 6, 7, 8, 9, 10, 11, 12, 13, 14, 15, 16, 17, or 18 amino acids that differ relative to the sequence of any one of SEQ ID NOs: 4-7.

The amino acid substitutions of any of these rAAV capsids particles may comprise one or more of Q263G, S264T, Y444F, T450A, P451E, S452G, T454L, T455K, Q457M, R459H, Q461L, S492D, A493G, D494E, E499D, and Y500F relative to the amino acid sequence of AAV2 VP1 capsid (SEQ ID NO: 1) or homologous amino acids of a wild-type VP1 capsid sequence of an AAV serotype other than AAV2 (e.g., AAV1, AAV3, AAV4, AAV5, AAV6, AAV7, AAV8, AAV9, AAV10, AAVrh.74, and AAVrh.10). In some embodiments, the amino acid substitutions of the capsid proteins of any of the described rAAV particles comprise E531G, K532R, S547A, E548G, T550N, V552A, D553A, E555G, K556Q, R585A, and R588A relative to the amino acid sequence of AAV2 VP1 capsid. In some embodiments, the amino acid substitutions comprise S264A, Y444F, T450D, P451R, S452G, T454S, Q457T, R459A, Q461S, S492D, A493G, D494E, E499D, and Y500F. In some embodiments, the amino acid substitutions comprise Q263A, S264A, Y444F, T450D, P451R, S452G, T454S, Q457T, R459A, Q461S, S492D, A493G, D494E, E499D, and Y500F. In some embodiments, the amino acid substitutions comprise E530N, E531D, K532R, S547A, E548K, K549G, D553A, I554V, R585A, and R588A. In some embodiments, the amino acid substitutions comprise Q263E, Y444F, T450A, P451S, S452A, T454S, Q457T, R459T, Q461G, T491Q, S492P, A493G, E499D, Y500F, E530D, E531D, and K532R.

In some embodiments, any of the disclosed capsids comprise a T491 substitution. In some embodiments, these capsids comprise a T491Q or T491V substitution. In some embodiments, any of the disclosed capsids comprise a DZGXSUXT motif at amino acid positions 450-457 of wild-type AAV2 capsid VP1 (SEQ ID NO: 1), where X is the wild-type position, Z is a mutation selected from T or R, and U is K or T. In some embodiments, any of the disclosed capsids comprise a DDR motif at amino acid positions 530-532 of SEQ ID NO: 1. In some embodiments, any of the disclosed capsids comprises a K527R mutation.

In some aspects, provided herein is a rAAV vector comprising a capsid and a genome, wherein the capsid comprises a VP1, VP2, and/or VP3 protein having amino acid substitutions as described in any of Tables 1-9, wherein these substitutions confer an increased transduction of GBM cells or GSC compared to an AAV particle comprising a capsid protein without the substitutions (such as a wild-type capsid protein). In some embodiments, the capsid has amino acid substitutions as described in any of Tables 1-8. In certain embodiments, the capsid comprises SEQ ID NO: 4.

Generation of Glioma Cell-Type Specific AAV.

In some embodiments, methods for generating AAV having enhanced tumor cell-type specific binding and transduction are described. The methods comprising use of a dynamic mode of administration of an AAV library reagent. Delivery of the AAV library is at least partially synchronized with tumor progression in a mouse model tumor. The AAV library, containing different cap proteins, is administered to a mouse harboring a tumor. The tumor may either be implanted (such as by injection of tumor cells), arise spontaneously, or be induced. The AAV library in administered to the tumor by infusion. As the tumor develops and grows, the infusion level is increased. In some embodiments, the intratumoral infusion of the AAV library is continuous. Initially, the infusion rate is slow. As the tumor grows, the infusion rates synchronized with early and late stage of tumor growth. By synchronized intratumoral infusion rate of the AAV library with early and late stage of tumor growth, a nearly 10-fold increase in AAV binding to the tumor and gene delivery is observed when compared to a single intratumor injection.

In some embodiments, synchronized delivery of an AAV library reagent in directed evolution screening for variants specific for slow GSC and fast GSC populations, and non-GSC GBM cell populations, resulted in infection of target cells.

AAV Having Increased Specificity for and/or Transduction of GSC and Non-GSC GBM Cell.

In some embodiments, AAV variants having increased specificity for binding and/or transduction of GBM and GSC are described. Such AAV variants contain altered capsid proteins. The altered capsid proteins contain amino acid substitutions in regions corresponding to amino acids 263-267, amino acids 444-461, amino acids 490-507, amino acids 527-532, amino acids 545-556, and amino acids 585-596, of the wild-type AAV2 VP1 capsid protein (SEQ ID NO: 1) (i.e, variable regions I, IV, V, VI, VII and VIII). These groupings of amino acids indicate the variable regions of AV2 VP1. The wild type amino acid sequences of the above regions are shown below (corresponds to SEQ ID NO: 8):

```
263     444                     490             527
QSGAS   YLSRTNTPSGTTTQSRLQ  KTSADNNNSEYSWTGATK  KDDEEK 545             585
QGSEKTNVDIEK  RGNRQAATADVN
```

The AAV variants can comprise altered VP2 and VP3 capsid proteins having amino acid substitutions corresponding to the amino acid substitutions of VP1. Amino acids 263-267, 444-461, 490-507, 527-532, 545-556, and 585-596 of capsid protein VP1 are underlined in SEQ ID NO: 1 below. Corresponding amino acids positions are underlined in capsid proteins VP2 and VP3, shown in SEQ ID 2 and SEQ ID NO: 3, respectively.

```
wild.type AAV2 VP1 amino acid sequence:
                             (SEQ ID NO: 1)
MAADGYLPDWLEDTLSEGIRQWWKLKPGPPPPKPA

ERHKDDSRGLVLPGYKYLGPFNGLDKGEPVNEADA

AALEHDKAYDRQLDSGDNPYLKYNHADAEFQERLK
```

-continued
```
EDTSFGGNLGRAVFQAKKRVLEPLGLVEEPVKTAP

GKKRPVEHSPVEPDSSSGTGKAGQQPARKRLNFGQ

TGDADSVPDPQPLGQPPAAPSGLGTNTMATGSGAP

MADNNEGADGVGNSSGNWHCDSTWMGDRVITTSTR

TWALPTYNNHLYKQISSQSGASNDNHYFGYSTPWG

YFDFNRFHCHFSPRDWQRLINNNWGFRPKRLNFKL

FNIQVKEVTQNDGTTTIANNLTSTVQVFTDSEYQL

PYVLGSAHQGCLPPFPADVFMVPQYGYLTLNNGSQ

AVGRSSFYCLEYFPSQMLRTGNNFTFSYTFEDVPF

HSSYAHSQSLDRLMNPLIDQYLYYLSRTNTPSGTT

TQSRLQFSQAGASDIRDQSRNWLPGPCYRQQRVSK

TSADNNNSEYSWTGATKYHLNGRDSLVNPGPAMAS

HKDDEEKFFPQSGVLIFGKQGSEKTNVDIEKVMIT

DEEEIRTTNPVATEQYGSVSTNLQRGNRQAATADV

NTQGVLPGMVWQDRDVYLQGPIWAKIPHTDGHFHP

SPLMGGFGLKHPPPQILIKNTPVPANPSTTFSAAK

FASFITQYSTGQVSVEIEWELQKENSKRWNPEIQY

TSNYNKSVNVDFTVDTNGVYSEPRPIGTRYLTRNL wild.type AAV2 VP2 amino acid sequence:
                                (SEQ ID NO: 2)
MAPGKKRPVEHSPVEPDSSSGTGKAGQQPARKRLN

FGQTGDADSVPDPQPLGQPPAAPSGLGTNTMATGS

GAPMADNNEGADGVGNSSGNWHCDSTWMGDRVITT

STRTWALPTYNNHLYKQISSQSGASNDNHYFGYST

PWGYFDFNRFHCHFSPRDWQRLINNNWGFRPKRLN

FKLFNIQVKEVTQNDGTTTIANNLTSTVQVFTDSE

YQLPYVLGSAHQGCLPPFPADVFMVPQYGYLTLNN

GSQAVGRSSFYCLEYFPSQMLRTGNNFTFSYTFED

VPFHSSYAHSQSLDRLMNPLIDQYLYYLSRTNTPS

GTTTQSRLQFSQAGASDIRDQSRNWLPGPCYRQQR

VSKTSADNNNSEYSWTGATKYHLNGRDSLVNPGPA

MASHKDDEEKFFPQSGVLIFGKQGSEKTNVDIEKV

MITDEEEIRTTNPVATEQYGSVSTNLQRGNRQAAT

ADVNTQGVLPGMVWQDRDVYLQGPIWAKIPHTDGH

FHPSPLMGGFGLKHPPPQILIKNTPVPANPSTTFS

AAKFASFITQYSTGQVSVEIEWELQKENSKRWNPE

IQYTSNYNKSVNVDFTVDTNGVYSEPRPIGTRYLT

RNL wild.type AAV2 VP3 amino acid sequence:
                                (SEQ ID NO: 3)
MATGSGAPMADNNEGADGVGNSSGNWHCDSTWMGD

RVITTSTRTWALPTYNNHLYKQISSQSGASNDNHY

FGYSTPWGYFDFNRFHCHFSPRDWQRLINNNWGFR
```

-continued
```
PKRLNFKLFNIQVKEVTQNDGTTTIANNLTSTVQV

FTDSEYQLPYVLGSAHQGCLPPFPADVFMVPQYGY

LTLNNGSQAVGRSSFYCLEYFPSQMLRTGNNFTFS

YTFEDVPFHSSYAHSQSLDRLMNPLIDQYLYYLSR

TNTPSGTTTQSRLQFSQAGASDIRDQSRNWLPGPC

YRQQRVSKTSADNNNSEYSWTGATKYHLNGRDSLV

NPGPAMASHKDDEEKFFPQSGVLIFGKQGSEKTNV

DIEKVMITDEEEIRTTNPVATEQYGSVSTNLQRGN

RQAATADVNTQGVLPGMVWQDRDVYLQGPIWAKIP

HTDGHFHPSPLMGGFGLKHPPPQILIKNTPVPANP

STTFSAAKFASFITQYSTGQVSVEIEWELQKENSK

RWNPEIQYTSNYNKSVNVDFTVDTNGVYSEPRPIG

TRYLTRNL
```

The amino acid substitutions in exemplary capsid proteins of AAV variants having enhanced specificity for and/or transduction of GBM and GSC are shown in Tables 1-9. In certain embodiments, capsid proteins shown in Table 9 are used in the disclosed methods, rAAV particles, and compositions thereof, for enhanced transduction of GBM and GSC cells, and accordingly, for use in treatments of glioma in subjects suffering therefrom.

VP1, VP2, and VP3 (collectively VPX) capsid protein amino acid substitutions providing increased specificity for and/or transduction of GBM and GSC are listing in Tables 1-8. Each row in the tables represents capsid protein amino acid substitutions in an AAV variant selected for binding and/or transduction of GSC in a combinatorial library directed evolution screen.

In some embodiments, the AAV particles can have altered VP1 capsid proteins, wherein the VP1 capsid proteins comprise a capsid protein having an amino acid sequence greater than 75%, greater than 80%, greater than 85%, greater than 90%, greater than 95%, greater than 96%, greater than 97%, greater than 98%, greater than 99%, or 100% identical to SEQ ID NO: 1, and having one or more of the amino acid substitutions as described in any of Tables 1-8.

In some embodiments, the AAV particles can have altered VP2 capsid proteins, wherein the VP2 capsid proteins comprises a capsid protein having an amino acid sequence greater than 75%, greater than 80%, greater than 85%, greater than 90%, greater than 95%, greater than 96%, greater than 97%, greater than 98%, greater than 99%, or 100% identical or similar to SEQ ID NO: 2, and having one or more of the amino acid substitutions as described in any of Tables 1-8.

In some embodiments, the AAV particles can have altered VP3 capsid proteins, wherein the VP3 capsid proteins comprises a capsid protein having an amino acid sequence greater than 75%, greater than 80%, greater than 85%, greater than 90%, greater than 95%, greater than 96%, greater than 97%, greater than 98%, greater than 99%, or 100% identical or similar to SEQ ID NO: 3, and having one or more of the amino acid substitutions as described in any of Tables 1-8.

In some embodiments, the AAV particles can have altered VP1 capsid proteins, altered VP2 capsid proteins, altered VP3 capsid proteins, or any combination thereof, each as described above.

In some embodiments, the AAV variants have increased specificity for and/or transduction of CD133+ GSC, CD44+ GSC, CD44−/CD133+ GSC, CD44+/CD133− GSC, CD44+/CD133+ GSC and/or CD44−/CD133− GBM cells. CD133+ GSC tend to be slow GSC; CD44+ GSC tend to be fast GSC. In some embodiments, CD133+ and/or CD44+ cells are GSC and CD133−/CD44− (double negative) cells are GBM cells. In some embodiments, GBM cells includes both GSC and non-GSC GBM cancer cells. In some embodiments, GSC can be CD133−/CD44−.

In some embodiments, AAV variants having increased specificity for and/or transduction of CD133+ GSC are described. CD133+ GSC can be CD44+ or CD44−. Such AAV variants comprise one or more VPX capsid proteins having amino acid substitutions as described in Table 1 and/or Table 2.

In some embodiments, AAV variants having increased specificity for and/or transduction of CD44+ GSC are described. CD44+ GSC can be CD133+ or CD133−. Such AAV variants comprise one or more VPX capsid proteins having amino acid substitutions as described in Table 7 and/or Table 8.

In some embodiments, AAV variants having increased specificity for and/or transduction of CD44−/CD133− GBM cells are described. Such AAV variants comprise one or more VPX capsid proteins having amino acid substitutions as described in Table 3 and/or Table 4.

In some embodiments, AAV variants having increased specificity for and/or transduction of CD44+/CD133+ GSC are described. Such AAV variants comprise one or more VPX capsid proteins having amino acid substitutions as described in Table 5 and/or Table 6.

In certain embodiments, an AAV variant having increased binding specificity for and/or transduction of GSC and/or non-GSC-GBM cells comprises an AAV having a capsid protein having amino acid substitutions E531G, K532R, S547A, E548G, T550N, V552A, D553A, E555G, K556Q, R585A, and R588A relative to the amino acid sequence of SEQ ID NO: 1.

In some embodiments, an AAV variant having increase binding specificity for and/or transduction of GSC and/or non-GSC-GBM cells comprises an AAV having a capsid protein having amino acid substitutions Q263G, S264T, Y444F, T450A, P451E, S452G, T454L, T455K, Q457M, R459H, Q461L, S492D, A493G, D494E, E499D, and Y500F relative to the amino acid sequence of SEQ ID NO: 1.

In some embodiments, an AAV variant having increased binding specificity for and/or transduction of GSC and/or non-GSC-GBM cells comprises an AAV having a capsid protein having amino acid substitutions S264A, Y444F, T450D, P451R, S452G, T454S, Q457T, R459A, Q461S, S492D, A493G, D494E, E499D, and Y500F relative to the amino acid sequence of SEQ ID NO: 1. In some embodiments, an AAV variant having increased binding specificity for and/or transduction of GSC and/or non-GSC-GBM cells comprises an AAV having a capsid protein having amino acid substitutions Q263A, S264A, Y444F, T450D, P451R, S452G, T454S, Q457T, R459A, Q461S, S492D, A493G, D494E, E499D, and Y500F relative to the amino acid sequence of SEQ ID NO: 1.

In some embodiments, an AAV variant having increased binding specificity for and/or transduction of GSC and/or non-GSC-GBM cells comprises an AAV having a capsid protein having amino acid substitutions E530N, E531D, K532R, S547A, E548K, K549G, D553A, I554V, R585A, and R588A relative to the amino acid sequence of SEQ ID NO: 1. In some embodiments, an AAV variant having increased binding specificity for and/or transduction of GSC and/or non-GSC-GBM cells comprises an AAV having a capsid protein having amino acid substitutions Q263E, Y444F, T450A, P451S, S452A, T454S, Q457T, R459T, Q461G, T491Q, S492P, A493G, E499D, Y500F, E530D, E531D, and K532R relative to the amino acid sequence of SEQ ID NO: 1.

Sequence identity can be determined by aligning sequences using algorithms, such as BESTFIT, FASTA, and TFASTA in the Wisconsin Genetics Software Package Release 7.0, Genetics Computer Group, 575 Science Dr., Madison, Wis.), using default gap parameters, or by inspection, and the best alignment (i.e., resulting in the highest percentage of sequence similarity over a comparison window). Percentage of sequence identity is calculated by comparing two optimally aligned sequences over a window of comparison, determining the number of positions at which the identical residues occurs in both sequences to yield the number of matched positions, dividing the number of matched positions by the total number of matched and mismatched positions not counting gaps in the window of comparison (i.e., the window size), and multiplying the result by 100 to yield the percentage of sequence identity. The portion of one polynucleotide or amino acid sequence in the comparison window may comprise additions or deletions (i.e., gaps) as compared to the other sequence (which does not comprise additions or deletions) for optimal alignment of the two sequences. Unless otherwise indicated the window of comparison between two sequences is defined by the entire length of the shorter of the two sequences.

For percent sequence identity in reference to proteins, it is understood that amino acids that are not identical can differ by conservative substitutions, wherein amino acid residues are substituted for amino acid residues with similar chemical properties (e.g., charge or hydrophobicity). Such substitutions are less likely to change the functional properties of the protein. When sequences differ in conservative substitutions, the percent sequence identity may be adjusted upwards to correct for the conservative nature of the substitution. Sequences that differ by such conservative substitutions are said to have "sequence similarity" or "similarity." Such analyses are well known in the art. Conservative substitution can be scored as a partial mismatch rather than a full mismatch, thereby increasing the percentage sequence identity (or similarity). The scoring of conservative substitutions is calculated, e.g., as implemented in the program PC/GENE (Intelligenetics, Mountain View, California).

Sequence identity/similarity values refer to the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. Other methods of determining similarity include, BLAST, PSI-BLAST, SSEARCH, and FASTA.

As used herein, "specificity" refers to the ability of an AAV particle to recognize and bind to a target cell. Such as a GBM cell or GSC. Increased specificity for GBM cells or GSC means that the AAV variant binds to the GBM cells or GSC with greater binding affinity than a similar AAV without the amino acid substitutions (such as a wild-type AAV capsid).

As used herein, "increased transduction" of GBM cells or GSC refers to that the AAV variant transduces GBM cells or GSC with greater efficiency than a similar AAV without the amino acid substitutions. As used herein, "transduction" refers to the intracellular introduction of a polynucleotide by a virus or viral vector, such as AAV, into a cell.

In some embodiments, nucleic acid molecules encoding any of the described AAV capsid proteins are contemplated. In some embodiments, gene delivery vectors containing any of the described AAV variants or AAV particles containing any of the described AAV capsid proteins are contemplated.

In some embodiments, host cells containing any of the described AAV variants or AAV particles containing any of the described AAV capsid proteins are contemplated. In various embodiments, host cells comprise GBM or GSC cells. In some embodiments, host cells comprise any one of CD133 and CD44 single positive, CD133/CD44 double positive and CD133/CD44 double negative GBM cells, or CD133 and CD44 single positive, CD133/CD44 double positive and CD133/CD44 double negative GSC cells.

In some embodiments, any of the described AAV variants can be used as a gene therapy vector. The described AAV variants are particularly useful in delivering heterologous nucleic acid regions transgenes (or heterologous genes or transgenes) to GBM or GSC cells. Any of the described AAV particles or an AAV particle comprising any of the described capsid proteins can comprise a genome containing a heterologous nucleic acid region. The heterologous nucleic acid sequence can encode a protein or ribonucleotide. The protein or ribonucleotide can be a therapeutic protein or ribonucleotide. A heterologous gene can contain an entire gene sequence of a partial gene sequence or a function fragment thereof. In some embodiments, a heterologous gene encodes an functional RNA. In some embodiments, a heterologous gene encodes a polypeptide or protein.

In some embodiments, methods of delivering a heterologous gene to a GBM cell or GSC are described, the methods comprising contacting a GBM cell or GSC cell with any of the described AAV variants or an AAV comprising any of the described capsid proteins.

Recombinant AAV Particles

Provided herein are variant rAAV (e.g., variant rAAV2) particles. In some embodiments, a particle is an empty particle (e.g., one that does not contain a nucleic acid vector comprising a heterologous gene). In some embodiments, an AAV2 particle contains a nucleic acid vector comprising a heterologous nucleic acid or heterologous gene. A heterologous gene is a gene that encodes a RNA or protein of interest.

In some embodiments, a rAAV2 particle containing any one of the variant rAAV (e.g., variant rAAV2) capsid proteins disclosed herein comprises ITRs and/or rep ORF of serotype 2. In some embodiments, a rAAV2 particle is a pseudotyped rAAV particle, which comprises (a) a capsid comprised of capsid proteins derived from serotype 2, and (b) a nucleic acid vector comprising ITRs from another serotype (e.g., AAV1, AAV3, AAV4, AAV5, AAV6, AAV7, AAV8, AAV9, or AAV10). For example, a particle may have ITRs of serotype 5 and a capsid of serotype 2. Such a pseudotyped rAAV particle would be designated AAV5/2.

A protein of interest may be a detectable marker or a therapeutic protein. A detectable marker is a molecule that can be visualized (e.g., using a naked eye or under a microscope). In some embodiments, the detectable marker is a fluorescent molecule, a bioluminescent molecule, or a molecule that provides color (e.g., β-galactosidase or Antares). In some embodiments, a detectable marker is a fluorescent protein or functional peptide or functional polypeptide thereof.

In some embodiments, a heterologous gene encodes a therapeutic protein and is referred to as a "therapeutic gene." A therapeutic gene may provide a therapeutic effect in a cell, tissue or organ to which it is delivered. In some embodiments, a therapeutic gene provides a therapeutic benefit to a cell, tissue or organ other than the one to which it is delivered. For example, a gene delivered to the brain tissue (e.g., the temporal or frontal lobe) may reach glioma or glioblastoma cells. In some embodiments, a therapeutic gene encodes an antibody, a peptibody, a growth factor, a clotting factor, a hormone, a membrane protein, a cytokine, a chemokine, an activating or inhibitory peptide acting on cell surface receptors or ion channels, a cell-permeant peptide targeting intracellular processes, a thrombolytic, an enzyme, a bone morphogenetic proteins, a nuclease or other protein used for gene editing, an Fc-fusion protein, an anticoagulant, a nuclease, a short hairpin RNA, an siRNA, a guide RNA, or other nucleic acid or protein for gene editing.

In some embodiments, a heterologous gene encodes a therapeutic RNA, e.g., a small interfering RNA or a short hairpin RNA. In certain embodiments, the heterologous gene encodes a shRNA targeting a master regulator gene. In certain embodiments, the heterologous gene encodes a shRNA targeting one or more of the Ascl-1 or Nkx6-2 genes, such as shRNA targeting one or more of the human ASCL-1 or NKX6-2 genes. In some embodiments, a therapeutic gene encodes a repair enzyme (e.g., MGMT), a checkpoint inhibitor, a transcription factor, a growth factor receptor, a growth factor ligand, or a tumor suppressor protein.

In some embodiments, a nucleic acid vector comprised in a rAAV particle comprises one or more of the following: (a) one or more heterologous nucleic acid regions comprising a heterologous gene, and (b) one or more regions comprising inverted terminal repeat (ITR) sequences (e.g., wild-type ITR sequences or engineered ITR sequences) flanking the one or more nucleic acid regions (e.g., heterologous nucleic acid regions). In some embodiments, a nucleic acid vector in a rAAV particle comprises one or more nucleic acid regions comprising a control sequence that facilitates expression of the heterologous nucleic acid region (e.g., a promoter). In some embodiments, a nucleic acid vector in a rAAV particle comprises one or more nucleic acid regions comprising a sequence that facilitates integration of the heterologous nucleic acid region (optionally with the one or more nucleic acid regions comprising a sequence that facilitates expression) into the genome of the subject.

Non-limiting examples of expression control sequences include promoters, insulators, silencers, response elements, introns, enhancers, initiation sites, termination signals, and poly(A) tails. Any combination of such control sequences is contemplated herein (e.g., a promoter and an enhancer).

In some embodiments, one or more promoters may be operably linked to a coding nucleotide sequence in the heterologous nucleic acid. A promoter is "operably linked" to a nucleotide sequence when the promoter sequence controls and/or regulates the transcription of the nucleotide sequence. A promoter may be a constitutive promoter, tissue-specific promoter, an inducible promoter, or a synthetic promoter.

For example, constitutive promoters of different strengths can be used. A nucleic acid vector described herein may include one or more constitutive promoters, such as viral promoters or promoters from mammalian genes that are generally active in promoting transcription. Non-limiting examples of constitutive viral promoters include the Herpes Simplex virus (HSV), thymidine kinase (TK), Rous Sarcoma Virus (RSV), Simian Virus 40 (SV40), Mouse Mammary Tumor Virus (MMTV), Ad E1A cytomegalovirus (CMV) promoters. Non-limiting examples of constitutive mammalian promoters include various housekeeping gene promoters, as exemplified by the β-actin promoter (e.g., chicken β-actin promoter) and human elongation factor-1 α (EF-1α) promoter. In some embodiments, chimeric viral/mammalian promoters may include a chimeric CMV/chicken beta actin (CBA, CB or CAG) promoters. In some embodiments, a shortened or truncated promoter is used.

Inducible promoters and/or regulatory elements may also be contemplated for achieving appropriate expression levels of the protein or polypeptide of interest. Non-limiting examples of suitable inducible promoters include those from genes such as cytochrome P450 genes, heat shock protein genes, metallothionein genes, and hormone-inducible genes, such as the estrogen gene promoter. Another example of an inducible promoter is the tetVP16 promoter that is responsive to tetracycline.

Tissue-specific promoters and/or regulatory elements are also contemplated herein. In some embodiments, it may be beneficial to combine a variant rAAV (e.g., variant rAAV2) particle as disclosed herein, with a promoter that also targets the same cells, tissue, or organ as the variant rAAV (e.g., variant rAAV2) particle. For example, a variant rAAV (e.g., variant rAAV2) particle that targets glioma or glioma stem-like cells might encapsidate a nucleic acid comprising a promoter that targets neural cells or neural stem cells.

Synthetic promoters are also contemplated herein. A synthetic promoter may comprise, for example, regions of known promoters, regulatory elements, transcription factor binding sites, enhancer elements, repressor elements, and the like.

It is to be understood that a promoter may be a fragment of any one of the promoters disclosed herein, or one that retains partial promoter activity (e.g., 10-90, 30-60, 50-80, 80-99 or 90-99.9% of the activity) of a whole promoter.

Any nucleic acid vector described herein may be encapsidated by a viral capsid. In some embodiments a cap gene is modified to express a fusion protein comprising a detectable marker and VP proteins of AAV serotype 2. In some embodiments, a peptide is inserted into the capsid protein either at position 587/588 or at the C-terminus of VP2. In some embodiments, the nucleic acid vector is circular. In some embodiments, the nucleic acid vector is single-stranded. In some embodiments, the nucleic acid vector is double-stranded. In some embodiments, a double-stranded nucleic acid vector may be, for example, a self-complementary vector that contains a region of the nucleic acid vector that is complementary to another region of the nucleic acid vector, initiating the formation of the double-strandedness of the nucleic acid vector.

Method of Making rAAV Particles

Various methods of producing rAAV particles and nucleic acid vectors are known (see, e.g., Zolotukhin et al. Production and purification of serotype 1, 2, and 5 recombinant adeno-associated viral vectors. *Methods* 28 (2002) 158-167; and U.S. Patent Publication Nos. 2007/0015238 and 2012/0322861, which are incorporated herein by reference; and plasmids and kits available from ATCC and Cell Biolabs, Inc.). In some embodiments, a vector (e.g., a plasmid) comprising a heterologous gene may be combined with one or more helper plasmids, e.g., that contain a rep gene (e.g., encoding Rep78, Rep68, Rep52 and Rep40) and a cap gene (encoding VP1, VP2, and VP3, including a modified VP region as described herein), and transfected into a recombinant cells, called helper or producer cells, such that the nucleic acid vector is packaged or encapsidated inside the capsid and subsequently purified.

Non-limiting examples of mammalian helper cells include HEK293 cells, COS cells, HeLa cells, BHK cells, or CHO cells (see, e.g., ATCC® CRL-1573™, ATCC® CRL-1651™, ATCC® CRL-1650™, ATCC® CCL-2, ATCC® CCL-10™, or ATCC® CCL-61™). A non-limiting example of an insect helper cells is Sf9 cells (see, e.g., ATCC® CRL-1711™). A helper cell may comprises rep and/or cap genes that encode the Rep protein and/or Cap proteins. In some embodiments, the packaging is performed in vitro (e.g., outside of a cell).

In some embodiments, a nucleic acid vector (e.g., a plasmid) containing the heterologous gene is combined with one or more helper plasmids, e.g., that contain a rep gene of a first serotype and a cap gene of the same serotype or a different serotype, and transfected into helper cells such that the rAAV particle is packaged. In some embodiments, the one or more helper plasmids include a first helper plasmid comprising a rep gene and a cap gene, and a second helper plasmid comprising one or more of the following helper genes: E1a gene, E1b gene, E4 gene, E2a gene, and VA gene. For clarity, helper genes are genes that encode helper proteins E1a, E1b, E4, E2a, and VA. Helper plasmids, and methods of making such plasmids, are known in the art and commercially available (see, e.g., pDF6, pRep, pDM, pDG, pDP1rs, pDP2rs, pDP3rs, pDP4rs, pDP5rs, pDP6rs, pDG (R484E/R585E), and pDP8.ape plasmids from PlasmidFactory, Bielefeld, Germany; other products and services available from Vector Biolabs, Philadelphia, PA; Cellbiolabs, San Diego, CA; Agilent Technologies, Santa Clara, Ca.; and Addgene, Cambridge, MA; pxx6; Grimm et al. (1998), Novel Tools for Production and Purification of Recombinant Adeno associated Virus Vectors, Human Gene Therapy, Vol. 9, 2745-2760; Kern, A. et al. (2003), Identification of a Heparin-Binding Motif on Adeno-Associated Virus Type 2 Capsids, Journal of Virology, Vol. 77, 11072-11081.; Grimm et al. (2003), Helper Virus-Free, Optically Controllable, and Two-Plasmid-Based Production of Adeno-associated Virus Vectors of Serotypes 1 to 6, Molecular Therapy, Vol. 7, 839-850; Kronenberg et al. (2005), A Conformational Change in the Adeno-Associated Virus Type 2 Capsid Leads to the Exposure of Hidden VP1 N Termini, Journal of Virology, Vol. 79, 5296-5303; and Moullier, P. and Snyder, R. O. (2008), International efforts for recombinant adeno-associated viral vector reference standards, Molecular Therapy, Vol. 16, 1185-1188). Plasmids that encode wild-type AAV coding regions for specific serotypes are also know and available. For example pSub201 is a plasmid that comprises the coding regions of the wild-type AAV2 genome (Samulski et al. (1987), J Virology, 6:3096-3101).

ITR sequences and plasmids containing ITR sequences are known in the art and are commercially available (see, e.g., products and services available from Vector Biolabs, Philadelphia, PA; Cellbiolabs, San Diego, CA; Agilent Technologies, Santa Clara, Ca.; and Addgene, Cambridge, MA; and Gene delivery to skeletal muscle results in sustained expression and systemic delivery of a therapeutic protein. Kessler P D, Podsakoff G M, Chen X, McQuiston S A, Colosi P C, Matelis L A, Kurtzman G J, Byrne B J. Proc Natl Acad Sci USA. 1996 Nov. 26; 93(24):14082-7; and Curtis A. Machida. Methods in Molecular Medicine™. Viral Vectors for Gene Therapy Methods and Protocols. 10.1385/1-59259-304-6:201 © Humana Press Inc. 2003. Chapter 10. Targeted Integration by Adeno-Associated Virus. Matthew D. Weitzman, Samuel M. Young Jr., Toni Cathomen and Richard Jude Samulski; U.S. Pat. Nos. 5,139,941 and 5,962,313, all of which are incorporated herein by reference). Genebank reference numbers for sequences of AAV serotypes 1, 2, 3, 3B, 4, 5, 6, 7, 8, 9, 10, 11, 12, and 13 are listed in patent publication WO 2012/064960, which is incorporated herein by reference.

A non-limiting method of rAAV particle production method is described next. One or more helper plasmids are produced or obtained, which comprise rep and cap ORFs for the desired AAV serotype and the adenoviral VA, E2A (DBP), and E4 genes under the transcriptional control of their native promoters. In some embodiments, the one or more helper plasmids comprise rep genes, cap genes, and optionally one or more of the adenoviral VA, E2A (DBP), and E4 genes under the transcriptional control of their native promoters. In some embodiments, the one or more helper plasmids comprise cap ORFs (and optionally rep ORFs) for the desired AAV serotype and the adenoviral VA, E2A (DBP), and E4 genes under the transcriptional control of their native promoters. The cap ORF may also comprise one or more modifications to produce a modified capsid protein as described herein. As an example, HEK293 cells (available from ATCC®) are transfected via CaPO4-mediated transfection, lipids or polymeric molecules such as polyethylenimine (PEI) with the helper plasmid(s) and a plasmid containing a nucleic acid vector. The HEK293 cells are then incubated for at least 60 hours to allow for rAAV particle production. Alternatively, the HEK293 cells are transfected via methods described above with AAV-ITR containing one or more genes of interest, a helper plasmid comprising genes encoding Rep and Cap proteins, and co-infected with a helper virus. Helper viruses are viruses that allow the replication of AAV. Examples of helper virus are adenovirus and herpesvirus.

Alternatively, in another example, Sf9-based producer stable cell lines are infected with a single recombinant baculovirus containing the nucleic acid vector. As a further alternative, in another example HEK293 or BHK cell lines are infected with a HSV containing the nucleic acid vector and optionally one or more helper HSVs containing rep and cap ORFs as described herein and the adenoviral VA, E2A (DBP), and E4 genes under the transcriptional control of their native promoters. The HEK293, BHK, or Sf9 cells are then incubated for at least 60 hours to allow for rAAV particle production. The rAAV particles can then be purified using any method known in the art or described herein, e.g., by iodixanol step gradient, CsCl gradient, chromatography, or polyethylene glycol (PEG) precipitation.

Methods for large-scale production of AAV using a herpesvirus-based system are also known. See for example, Clement et al. (Hum Gene Ther. 2009, 20(8):796-806). Methods of producing exosome-associated AAV, which can be more resistant to neutralizing anti-AAV antibodies, are also known (Hudry et al., Gene Ther. 2016, 23(4):380-92; Macguire et al., Mol Ther. 2012, 20(5):960-71).

Methods for producing and using pseudotyped rAAV vectors are also known in the art (see, e.g., Duan et al., J. Virol., 75:7662-7671, 2001; Halbert et al., J. Virol., 74:1524-1532, 2000; Zolotukhin et al., Methods, 28:158-167, 2002; and Auricchio et al., Hum. Molec. Genet., 10:3075-3081, 2001).

Compositions

Various formulations have been developed to facilitate rAAV particle use. For example, for administration of an injectable aqueous solution of rAAV particles, the solution may be suitably buffered, if necessary, and the liquid diluent first rendered isotonic with sufficient saline or glucose. In some embodiments, a composition as provided herein comprises a plurality of any one of the variant rAAV (e.g., variant rAAV2) particles disclosed herein. In some embodiments, a composition comprises pluralities of more than one of the variant rAAV (e.g., variant rAAV2) particles disclosed herein. In some embodiments, "administering" or "administration" means providing a material to a subject in a manner that is pharmacologically useful.

Accordingly, in some embodiments, a composition of variant rAAV particles comprises a pharmaceutically acceptable carrier. The term "carrier" refers to a diluent, adjuvant, excipient, or vehicle with which the rAAV particle is administered. Such pharmaceutical carriers can be sterile liquids (e.g., water, oils, saline solutions, aqueous dextrose and glycerol solutions), suspending agents, preserving agents (e.g., methyl-, ethyl-, and propyl-hydroxy-benzoates), and pH adjusting agents (such as inorganic and organic acids and bases). In some embodiments, carriers include buffered saline solutions (e.g., phosphate buffered saline, HEPES-buffered saline). USP grade carriers and excipients are particularly useful for delivery of rAAV particles to human subjects. Such compositions may further optionally comprise a liposome, a lipid, a lipid complex, a microsphere, a microparticle, a nanosphere, or a nanoparticle, or may be otherwise formulated for administration to the cells, tissues, organs, or body of a subject in need thereof. Methods for making such compositions are well known and can be found in, for example, Remington: The Science and Practice of Pharmacy, 22nd edition, Pharmaceutical Press, 2012.

In some embodiments, a composition comprising any one of the rAAV particles disclosed herein comprises Balanced Salt Solution (BSS) supplemented with 0.014% Tween 20 (polysorbate 20). In some embodiments, a composition comprising any one of the rAAV particles disclosed herein comprises 100 mM sodium citrate, 10 mM Tris, pH 8.0, supplemented with 0.001% Pluronic F-68.

In some embodiments, the number of rAAV particles administered to a host cell may be on the order ranging from 500 to 5,000 vector genomes (vgs)/cell. In particular embodiments, the disclosed methods comprise administration of rAAV particles in doses of about 500 vgs/cell, 1000 vgs/cell, 2000 vgs/cell, 3000 vgs/cell, 4000 vgs/cell, 5000 vgs/cell, 6000 vgs/cell or 7000 vgs/cell.

In some embodiments, the number of rAAV particles administered to a subject may be on the order ranging from $10^6$ to $10^{14}$ particles/mL or $10^3$ to $10^{13}$ particles/mL, or any values therebetween for either range, such as for example, about $10^6$, $10^7$, $10^8$, $10^9$, $10^{10}$, $10^{11}$, $10^{12}$, $10^{13}$, or $10^{14}$ particles/mL. In one embodiment, rAAV particles of higher than $10^{13}$ particles/mL are be administered. In some embodiments, the number of rAAV particles administered to a subject may be on the order ranging from $10^6$ to $10^{14}$ vgs/mL or $10^3$ to $10^{15}$ vgs/mL, or any values there between for either range, such as for example, about $10^6$, $10^7$, $10^8$, $10^9$, $10^{10}$, $10^{11}$, $10^{12}$, $10^{13}$, or $10^{14}$ vgs/mL. In certain embodiments, the disclosed methods comprise administration of rAAV particle compositions in doses of $3 \times 10^3$–$1 \times 10^4$ vgs/mL. In one embodiment, rAAV particles of higher than $10^{13}$ vgs/mL are be administered.

The rAAV particles can be administered as a single dose, or divided into two or more administrations as may be required to achieve therapy of the particular disease or disorder being treated. In some embodiments, 0.0001 mL to 10 mL are delivered to a subject.

In some embodiments, the disclosure provides formulations of compositions disclosed herein in pharmaceutically acceptable solutions for administration to a cell or an animal, either alone or in combination with one or more other modalities of therapy, and in particular, for therapy of human cells, tissues, and diseases affecting man.

If desired, rAAV particle or preparation and nucleic acid segments may be administered in combination with other agents as well, such as, e.g., proteins or polypeptides or various pharmaceutically-active agents, including one or more systemic or topical administrations of therapeutic polypeptides, biologically active fragments, or variants thereof. In fact, there is virtually no limit to other components that may also be included, given that the additional agents do not cause a significant adverse effect upon contact with the target cells or host tissues. The rAAV particles or preparations and nucleic acid segments may thus be delivered along with various other agents as required in the particular instance. Such compositions may be purified from host cells or other biological sources, or alternatively may be chemically synthesized as described herein. As used herein, the term "vector" can refer to a nucleic acid segment (e.g., a plasmid or recombinant viral genome) or a viral vector (e.g., an rAAV particle comprising a recombinant genome).

Typically, compositions may contain at least about 0.1% of the therapeutic agent (e.g., rAAV particle) or more, although the percentage of the active ingredient(s) may be varied and may conveniently be between about 1 or 2% and about 70% or 80% or more of the weight or volume of the total formulation. Naturally, the amount of therapeutic agent(s) (e.g., rAAV particle) in each therapeutically-useful composition may be prepared in such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable.

The pharmaceutical forms of rAAV particle compositions suitable for injectable use include sterile aqueous solutions or dispersions. In some embodiments, the form is sterile and fluid to the extent that easy syringability exists. In some embodiments, the form is stable under the conditions of manufacture and storage and is preserved against the contaminating action of microorganisms, such as bacteria and fungi. In some embodiments, the form is sterile. The carrier can be a solvent or dispersion medium containing, for example, water, saline, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants.

Preparation of compositions for administration to a subject are known in the art. For example, a dosage may be dissolved in 1 ml of isotonic NaCl solution and either added to 1000 ml of hypodermoclysis fluid or injected at the proposed site of infusion, (see for example, Remington's Pharmaceutical Sciences, 15th Ed., 1035-1038 and 1570-1580). Some variation in dosage will necessarily occur depending on the condition of the subject being treated. The person responsible for administration will, in any event, determine the appropriate dose for the individual subject. Moreover, for human administration, preparations should meet sterility, pyrogenicity, and the general safety and purity standards as required by, e.g., FDA Office of Biologics standards.

In some embodiments, a cell, tissue or organ is transduced in vivo, for example, for the purposes of treating a disease. In some embodiments, a cell, tissue or organ of the CNS is transduced in vivo. In some embodiments, brain tissue or brain cells is transduced in vivo. In some embodiments, a disease associated with the CNS is treated by administering one or more of the disclosed rAAV particles or compositions. In particular embodiments, a disease associated with glioma or glioblastoma is treated.

In some embodiments, "administering" or "administration" means providing a material to a subject in a manner that is pharmacologically useful. In some embodiments, a rAAV particle is administered to a subject enterally. In some embodiments, an enteral administration of the essential metal element/s is oral. In some embodiments, a rAAV particle is administered to the subject parenterally. In some embodiments, a rAAV particle is administered to a subject intratumorally, intraocularly, subcutaneously, intravenously (IV), intra-arterially, intracerebrally, intraventricularly, intramuscularly, intrathecally (IT), intracisternally, intraperitoneally, via inhalation, topically, or by direct injection to one or more cells, tissues, or organs (e.g., the brain). In certain embodiments, rAAV particle delivery is intratumoral.

In some embodiments, a subject in which a cell, tissue or organ is transduced is a vertebrate animal (e.g., a mammal or reptile). In some embodiments, a mammalian subject is a human, a non-human primate, a dog, a cat, a hamster, a mouse, a rat, a pig, a horse, a cow, a donkey or a rabbit. Non-limiting examples of non-human primate subjects include macaques (e.g., cynomolgus or rhesus macaques), marmosets, tamarins, spider monkeys, owl monkeys, vervet monkeys, squirrel monkeys, baboons, gorillas, chimpanzees, and orangutans. In some embodiments, a subject is a model for a particular disease or used to study the pharmacokinetics and/or pharmacokinetics of a protein or siRNA encoded by a heterologous gene.

To "treat" a disease as the term is used herein, means to reduce the frequency or severity of at least one sign or symptom of a disease or disorder experienced by a subject. The compositions described above or elsewhere herein are typically administered to a subject in an effective amount, that is, an amount capable of producing a desirable result. The desirable result will depend upon the active agent being administered. For example, an effective amount of rAAV particles may be an amount of the particles that are capable of transferring an expression construct to a host cell, tissue or organ. A therapeutically acceptable amount may be an amount that is capable of treating a disease, e.g., stroke. As is well known in the medical and veterinary arts, dosage for any one subject depends on many factors, including the subject's size, body surface area, age, the particular composition to be administered, the active ingredient(s) in the composition, time and route of administration, general health, and other drugs being administered concurrently.

EXAMPLES

Example 1

AAV2 Delivery

Figure 1A:
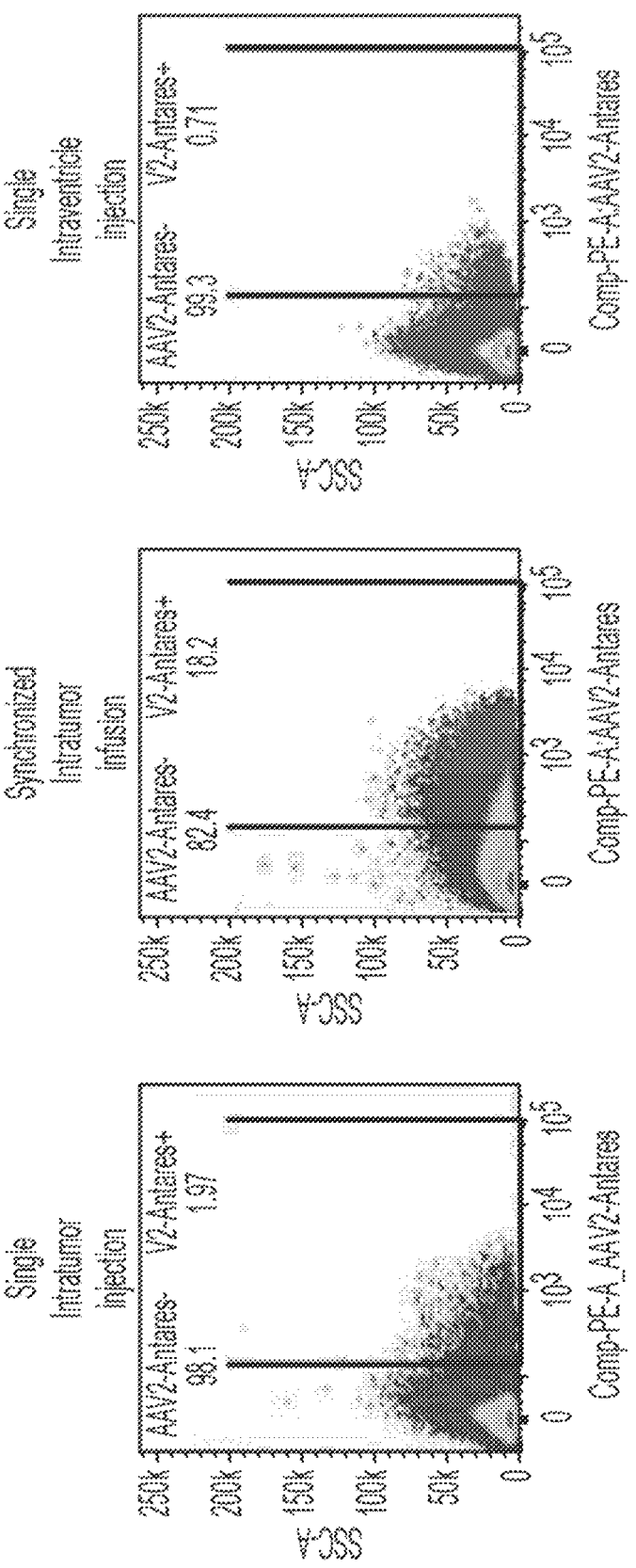
FIG. 1A. AAV delivery synchronized with tumor progression was superior in tumor infection compared to single injections intra-tumoral or intra-ventricular injections.
Figure 1B:
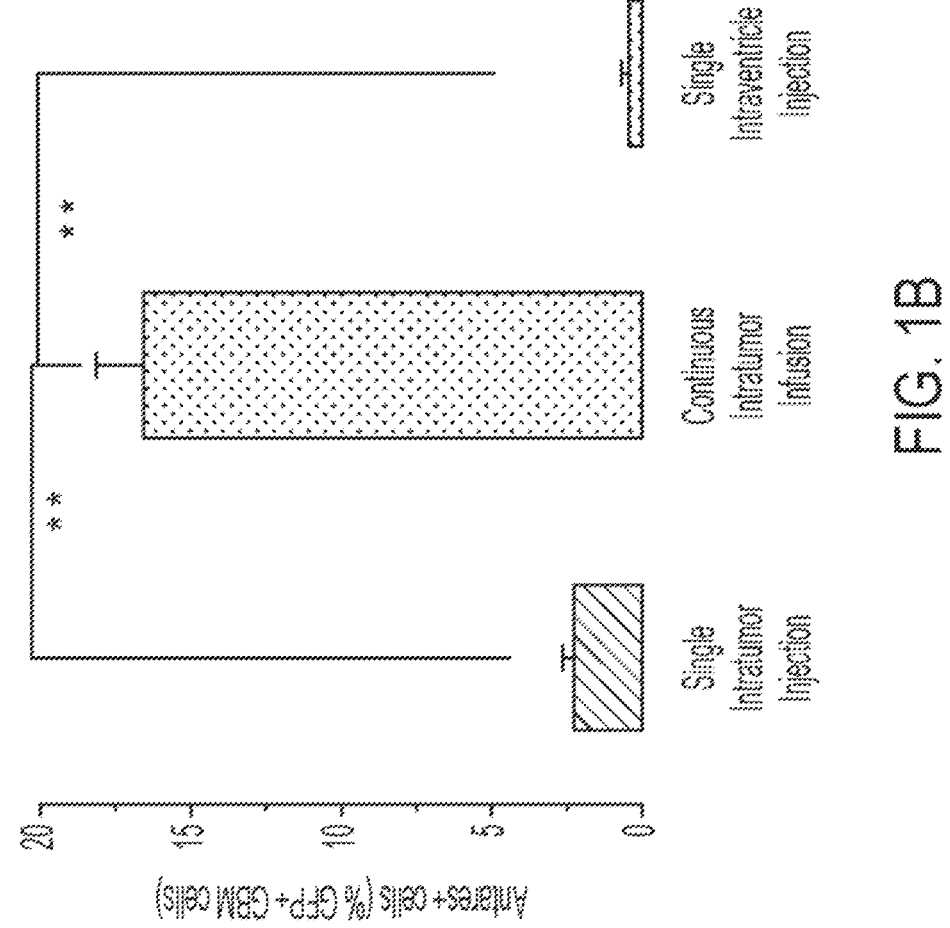
FIG. 1B. Dissociated GPP+ tumor cells were sorted for Antares expression.
Figure 1C:
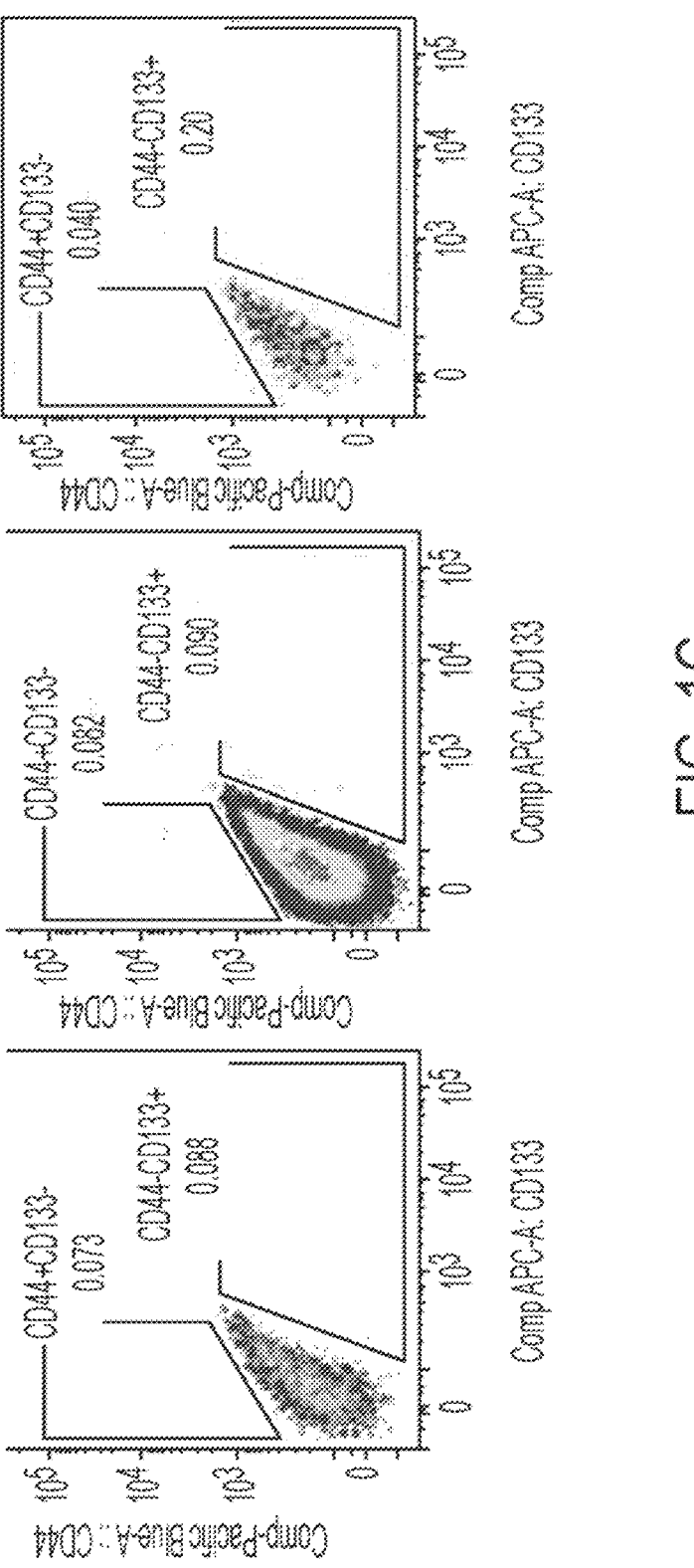
FIG. 1C. The fraction of Antares-expressing cells is one order of magnitude when using higher in synchronized continuous infusions, Ttest $p<0.01$.

A dynamic mode of administration of a library reagent synchronized with tumor progression was evaluated. The AAV vector under evaluation expressed Antares, a cyan-excitable orange fluorescent reporter gene. The Antares gene consists of an optimized fusion of CyOFP1 and NanoLuc luciferase and functions as a highly sensitive bioluminescent reporter in vivo, producing substantially brighter signals from deep tissues than firefly luciferase and other bioluminescent proteins. (See Chu et al., Nat Biotechnol. 2016 July; 34(7): 760-767, herein incorporated by reference.) Continuous intratumor graded infusion of an AAV2-Antares vector reagent that was synchronized with tumor progression (i.e. slow to fast infusion rates synchronized with early and late stage of tumor growth) resulted in nearly 10-fold increase in Antares gene delivery when compared to a single intratumor injection. Synchronized delivery of an AAV reagent in directed evolution screening for variants specific for slow and fast GSC populations and non-GSC GBM cell population resulted in infection of target cells (FIGS. 1A-1C).

Example 2

Directed Evolution Screen of an AAV2 Library

Figure 2:
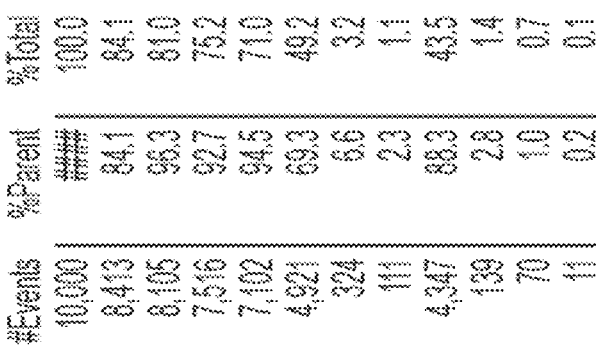
FIG. 2. A Glioblastoma (GBM) Patient derived Xenograft (PDX) in a directed evolution screen with an AAV2 library. GFP+ tumor cells were sorted for CD133 and CD44 with typical frequencies shown.
Figure 2:
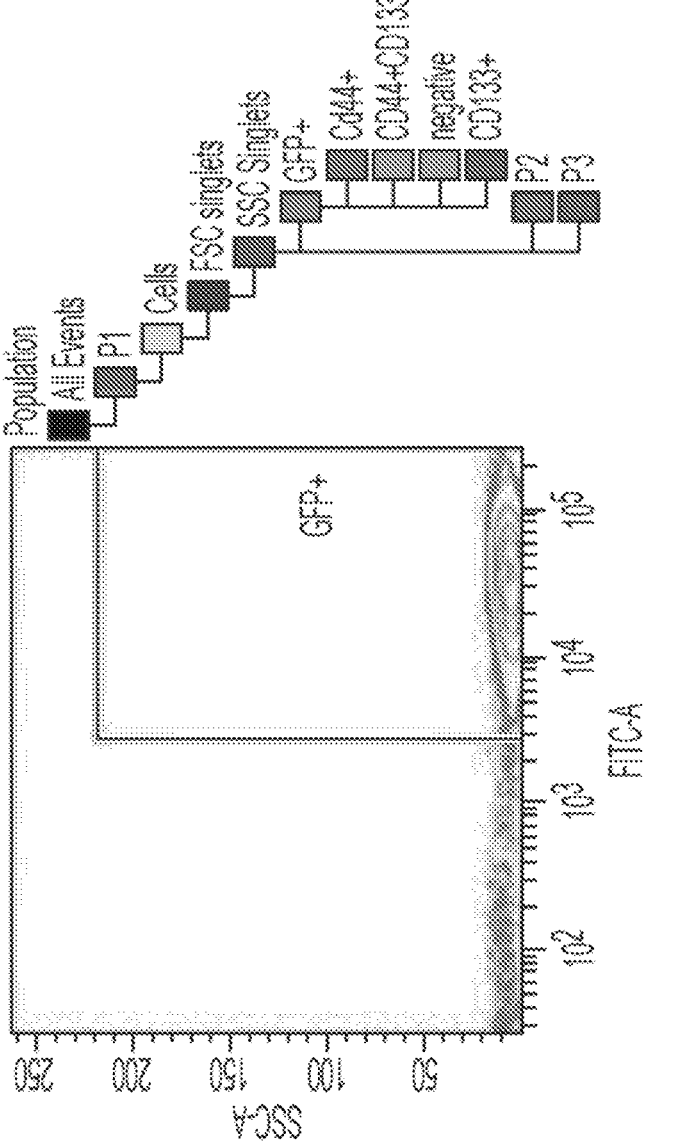

Three rounds of directed evolution screening, using an AAV2 library (~107 complexity of variants) in 3 GFP/luciferase-labeled GSC lines and at least 5 animals in each group. Tumor growth was monitored by bioluminescent imaging (BLI). For each round, AAV2 infusion was synchronized with tumor growth using an Alzet pump implanted subcutaneously (s.q.) in the animal's back. The catheter was inserted intratumorally. AAV2 library was infused over a period of at least 2 weeks, with infusion rate doubled in the second week when tumor growth accelerated, followed by a 1-week rest period to allow for maximal viral transduction. Tumors were harvested and analyzed by FACS; gated for GFP, and sorted for CD133 and CD44 single positive, CD133/CD44 double positive and CD133/CD44 double negative populations (FIG. 2). Two rounds of directed evolution screening were conducted in each cell population to provide the results shown in Tables 1-8. Subsequently, a third round of evolution was conducted to provide the 23 variants that conferred the highest increase of (or improvement in) transduction across all four cell types. These directed evolution (DE) experiments presuppose that capsid variants are homogeneously distributed among the AAV2 viral library.

Example 3

Next Generation Sequencing (NGS) and Bioinformatics

Figure 3:
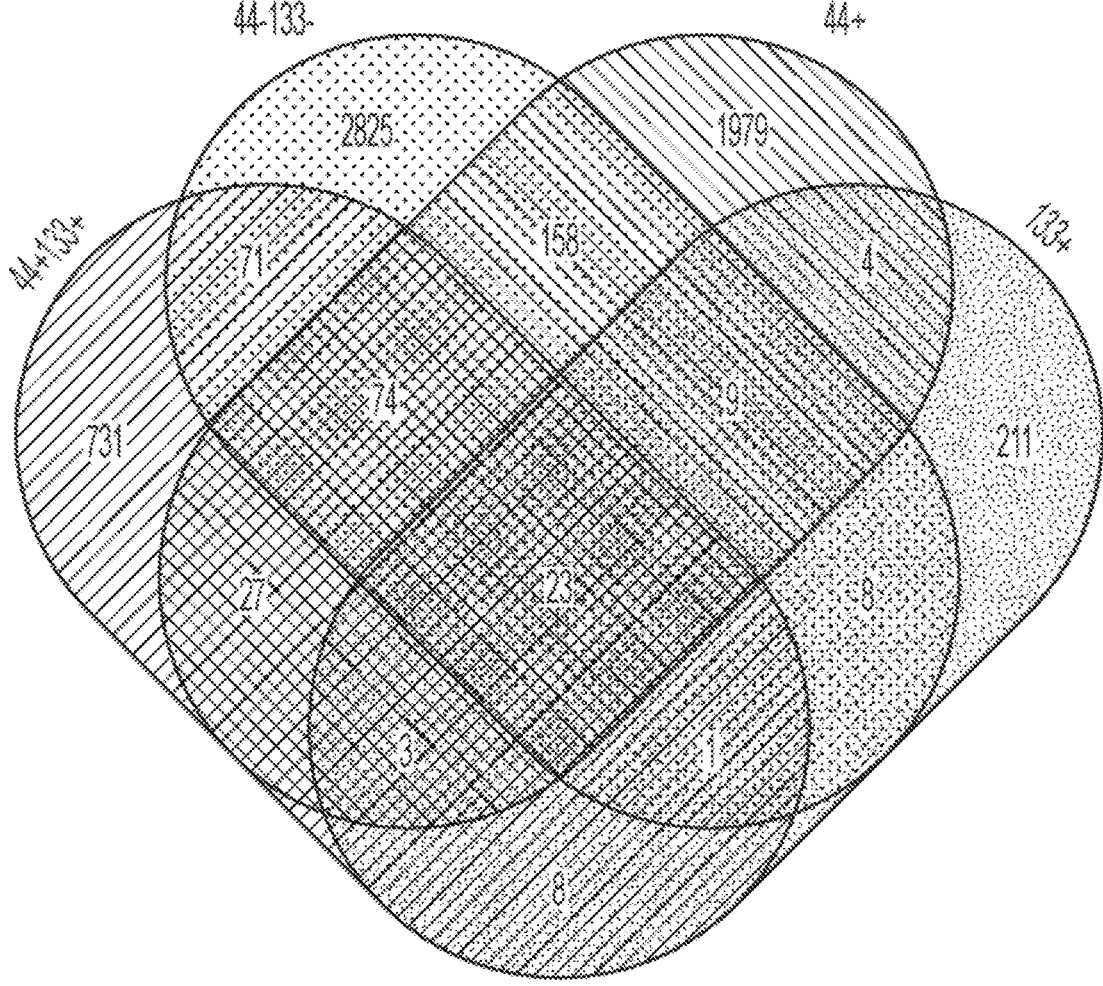
FIG. 3. Venn diagram of capsid variant sequences transducing various GSC populations and non-GSC-GBM cells after 3 rounds of directed evolution screening.
Figure 4:
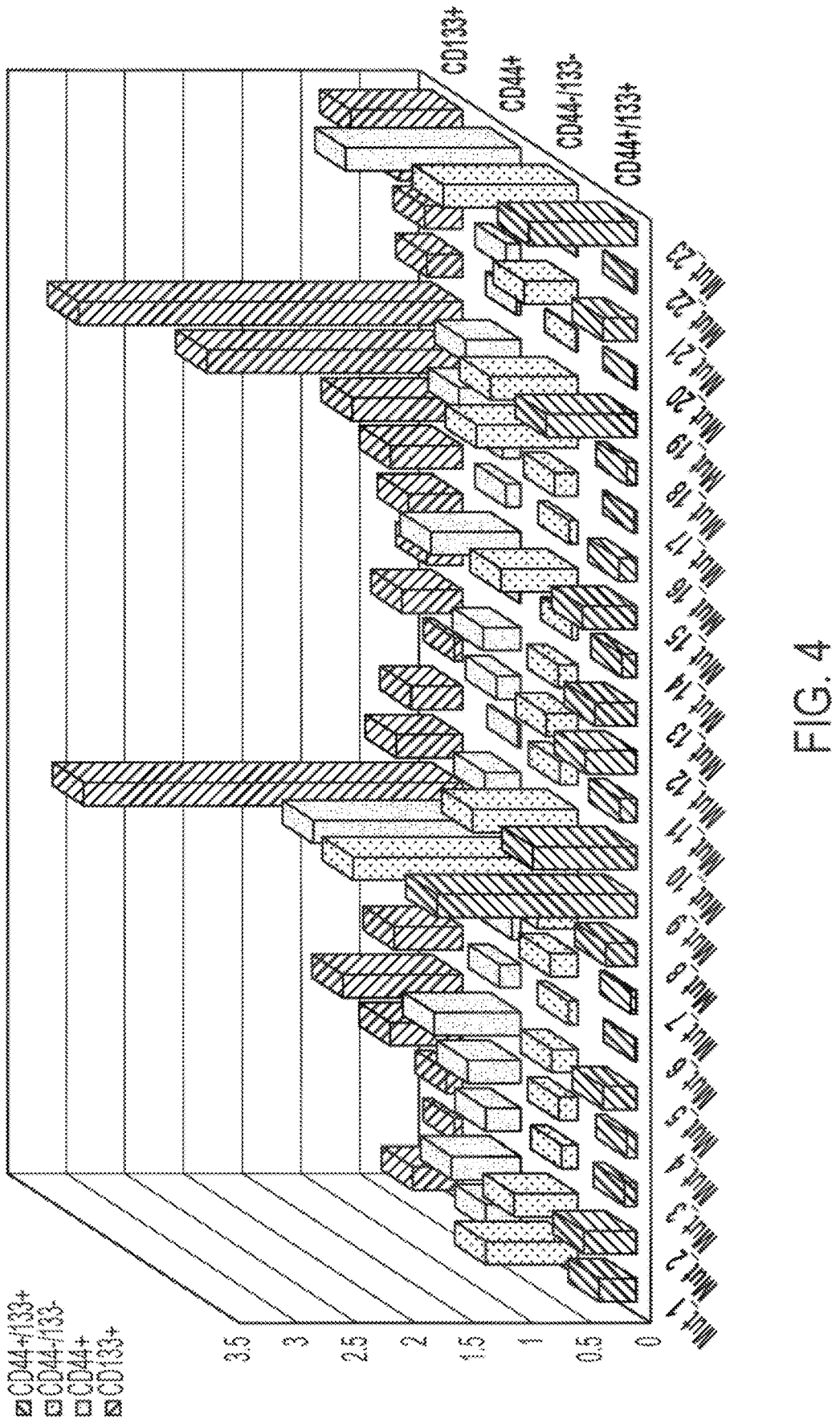
FIG. 4. The 23 mutant (Mut) sequences enriched in all GSC populations and non-GSC-GBM cell populations (see FIG. 3). Mutants 9, 10, 18, 19 and 23 had the broadest overlaps.

After each round of directed evolution, viral DNA was isolated from each cell population and subjected to next generation sequencing (NGS) and bioinformatics analysis using dedicated software. A clustering analysis identified several enriched AAV capsid variants that exhibited increased recognition and transduction of each population of GSCs and non-GSC-GBM cells. 23 AAV variants (Mut) recognized and transduced all types tested, including CD44 (+), CD133(+), and double negative cells (FIGS. 3 and 4).

Next generation sequencing was used to identify the amino acid substitutions in the capsid proteins of AAV particles identified in the directed evolution screen that conferred enhanced transduction. Results of these sequencing evaluations are shown in Tables 1-8. Variants are shown along with the "enrichment factor" of the rAAV vector (or genome) associated with each variant. The enrichment factor ("%") refers to the percentage of all nucleotide sequence reads (or "copies") that are represented by the genome associated with a particular variant, in the particular screening round. (Reads are determined through next-generation sequencing (NGS) of the genomes.) The higher the value of this percentage, the better the variant is suited to target and infect these particular cell types so that they integrate the rAAV genome. After a single screening round, variants generating a higher percentage of sequence reads may be selected as better (or the best) candidates. In that scenario, the % shown is equivalent to the fraction of (count of individual mutant genome reads)/(count of all mutant genome reads in the DNA sample). For example, if 10,000 copies of Mutant #1 were recovered after analysis of of a total of 1000,000 copies of DNA (for that sample) were screened, then the % for Mutant #1 is calculated as (10,000/1000,000)*100%, or 1%.

The fold-change values describing enrichment between two rounds of screening (e.g., rounds 1 and 2 of selection in in CD133+ GSC cells) may be calculated as:

$$\text{DNA enrichment} = \frac{\% \text{ in reads after } NGS \text{ of DNA Round 1}}{\% \text{ of reads after } NGS \text{ of in DNA Round 2}} =$$

$$\frac{5\%}{1\%} = 5 \text{ times (round 1 to 2 enrichment)}.$$

Accordingly, in some embodiments, the capsid variant of any of the disclosed rAAV particles comprises a polypeptide sequence that exhibits an enrichment factor (%) in GBM and/or GSC cells that is greater than 0.01, 0.05, 0.1, 0.15, 0.2, 0.25, 0.3, 0.35, 0.4, 0.45, 0.5, 1.0 1.5, 2.0, 2.5, 3.0, 3.5, 4.0, 4.5, 5.0, 5.5, 6.0, 6.5, 7.0, 7.5, 8.0, 8.5, 9.0, 9.50, 10.0, 11.0, 12.0, 13.0, 14.0, 15.0, 16.0, 17.0, 18.0, 19.0, 20.0, 30.0, 40.0, 50.0, 60.0, 70.0, 80.0, 90.0, or 95.0, optionally greater than 10.0, or 20.0, 30.0, 40.0, 50.0, 60.0, 70.0, 80.0, or 90.0. In particular embodiments, the capsid variants exhibit an enrichment factor of greater than 10.0, 11.0, 12.0, 13.0, 14.0, 15.0, or 20.0. For example, the capsid may comprise a sequence that comprises the mutations of any of SEQ ID NO:s 4, 5, 6, 7, or 9-7010 relative to SEQ ID NO: 8 (e.g., the mutations of SEQ ID NOs: 4-7 and 9-28) and that demonstrates an enrichment factor as described above.

A key to the tables is as follows:

Table 1 depicts an alignment of amino acid sequences of the pool of variants following Round 1 selection in CD133$^+$ GSC cells against SEQ ID NO: 8, which corresponds to the variable regions I, IV, V, VI, VII and VIII of the wild-type AAV2 VP1 capsid protein.

Table 2 depicts an alignment of amino acid sequences of the pool of variants following Round 2 selection in CD133$^+$ GSC cells.

Table 3 depicts an alignment of amino acid sequences of the pool of variants following Round 1 selection in CD44$^-$/CD133$^-$ GBM cells.

Table 4 depicts an alignment of amino acid sequences of the pool of variants following Round 2 selection in CD44$^-$/CD133$^-$ GBM cells.

Table 5 depicts an alignment of amino acid sequences of the pool of variants following Round 1 selection in CD44$^+$/CD133$^+$ GSC cells.

Table 6 depicts an alignment of amino acid sequences of the pool of variants following Round 1 selection in CD44$^+$/133$^+$ GSC cells.

Table 7 depicts an alignment of amino acid sequences of the pool of variants following Round 1 selection in CD44$^+$ GSC cells.

Table 8 depicts an alignment of amino acid sequences of the pool of variants following Round 2 selection in CD44$^+$ GSC cells.

Table 9 depicts an alignment of amino acid sequences of sequences of the top 23 capsid variants selected by three rounds of directed evolution targeting all four GSC and GBM cell populations, against SEQ ID NO: 8.

TABLE 1

AAV capsid proteins having increased specificity for and/or transduction
of CD133* GSC (pool of Round 1 selection). Amino acid numbers correspond
to the amino acid sequence of VP1 (SEQ ID NO: 1). The percentage value in
the penultimate column indicates the "enrichment factor." Sequences below
correspond to SEQ ID NOs: 8 and 29.295 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................ | ................ | ...NDR | ..AKG...AV.. | A..A........ | 3.25 | 250 |
| ..... | ................ | ................ | ....GR | ..AG.N.AA.GQ | A..A........ | 3.23 | 248 |
| GT... | F.....AEG.LK.M.H.L | ..DGE....DF...... | ...... | ........... | ............ | 2.17 | 167 |
| ..... | F................ | .V........F...... | ...... | ........... | ARRDE..ANT.H | 1.53 | 118 |
| EA... | ................ | .Q.......DF...... | ...AD. | EDGGGS..EYGS | A..A........ | 1.34 | 103 |
| SA... | ................ | ................ | E..TG. | ........... | A..A......H | 1.20 | 92 |
| .A... | ................ | ................ | R...DR | E.ARE...E.DQ | A..A........ | 1.20 | 92 |
| SA... | F....ATT.IM.T.T.R | .V........F...... | ...... | ...KANDTEY.S | A..A........ | 1.18 | 91 |
| ..... | F................ | .V........F...... | ...... | ........... | ATSDH..NR..A | 1.16 | 89 |
| EA... | ................ | T..NE....DF......T | R..DD. | ........... | ............ | 1.13 | 87 |
| ..... | ................ | .V........F...... | ...... | ........... | ............ | 1.01 | 78 |
| RA... | F.....GQG.IA.....K | ................ | ...... | ........... | A..A...... | 1.01 | 78 |
| GT... | F.......G.HK.T.N.G | ..HG.....NF......T | E..N.. | E.......... | A..A........ | 1.00 | 77 |
| ..... | ................ | ................ | ...... | ..AKA.DTEV.Q | A..A........ | 0.99 | 76 |
| ..... | ................ | ................ | ....D. | ........... | A..A........ | 0.95 | 73 |
| E.... | F.....ASA.S..T.T.G | .QPG.....DF...... | ...DDR | ........... | A..A........ | 0.95 | 73 |
| ..... | ................ | ................ | ...D.. | .NATG....VGS | A..A........ | 0.91 | 70 |
| ..... | ................ | ................ | ...DG. | ES.GT...A.DG | A..A........ | 0.90 | 69 |
| GT... | ................ | ..PDG....NF...... | ....DR | ........... | A..A........ | 0.90 | 69 |
| NT... | ................ | ..YN......F......T | ...N.. | ........... | A..A........ | 0.88 | 68 |
| ..... | ................ | .................T | R..D.R | .D.TR..AA..Q | A..A........ | 0.87 | 67 |
| RT... | ................ | TKDDR....DF...... | ...DDR | EDGATG...VDR | A..A........ | 0.85 | 65 |
| AA... | F.....G.G.HM.M.S.M | T.P......DF...... | ...D.. | ........... | A..A........ | 0.83 | 64 |
| ..... | ..........N.T.R | .QHNQ.....F......T | ...N.. | E.AA.SD.AVGG | A..A........ | 0.83 | 64 |
| ..... | ................ | ................ | ...DDR | EDGNTN.A.VDS | A..A........ | 0.83 | 64 |
| ..... | ................ | ................ | ...DDR | ..AG...IAYGN | A..A........ | 0.83 | 64 |
| ..... | F................ | .V........F...... | ...... | ........... | TSKAT..FRE.T | 0.83 | 64 |
| ST... | ...............T.N | ................ | ...... | ..TG.D..A.GG | A..A........ | 0.81 | 62 |
| ..... | F.....D.G..Q.N...R | ..A.............. | ...... | ........... | ............ | 0.79 | 61 |
| ..... | ................ | .V........F...... | ...... | ENAAGND.AVDR | A..A........ | 0.79 | 61 |
| .A... | F................ | .PPNG.....F......T | ...DDR | E.ASE...E.D. | A..A........ | 0.78 | 60 |
| ..... | ................ | ................ | G..N.. | ........... | A..A........ | 0.75 | 58 |
| ..... | F................ | .V........F...... | ...... | ........... | KTKNP...GE.H | 0.74 | 57 |
| ..... | ................ | .QPSQ....NF...... | G..DD. | ........... | A..A........ | 0.74 | 57 |
| A.... | F.....ATG.NN..I.S.G | .QPN......F......T | ...N.. | ........... | A..A........ | 0.73 | 56 |
| RT... | F.....ARG.I..T.A.K | ..DGE....DF...... | ...... | E.AG.S..E.DN | A..A........ | 0.70 | 54 |

TABLE 1-continued

AAV capsid proteins having increased specificity for and/or transduction
of CD133* GSC (pool of Round 1 selection). Amino acid numbers correspond
to the amino acid sequence of VP1 (SEQ ID NO: 1). The percentage value in
the penultimate column indicates the "enrichment factor." Sequences below
correspond to SEQ ID NOs: 8 and 29.295 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | ................. | ................. | .D.... | .DAGRN.IA.DG | A..A........ | 0.69 | 53 |
| ..... | F.....GTG.P....K.. | .........NF....... | R...D. | .DGKGND...DG | A..A........ | 0.68 | 52 |
| ..... | ................. | ................. | F...AD. | .DAG.S.A..DR | A..A........ | 0.68 | 52 |
| RA... | ................. | .PDNR..T.DF......T | ..GR | ........... | A..A........ | 0.68 | 52 |
| ..... | ................. | ................. | .DDR | E.GATG...VD. | A..A........ | 0.65 | 50 |
| TA... | F......AG.S..T.K.K | ..DD.....DF....... | ....D. | ESTDRG.A..GE | A..A........ | 0.65 | 50 |
| R.... | F.....SR...V.N.H.E | T.P......DF....... | ...D.. | ...G.S..AFGD | A..A........ | 0.65 | 50 |
| AA... | ................. | TQ..H....NF....... | ...... | ........... | A..A........ | 0.62 | 48 |
| ..... | ................. | ................. | ...N.. | ........... | A..A........ | 0.62 | 48 |
| TA..T | F.....NE..SD.H...K | Q.DR......F....... | ....D. | ..NAG.DD..DQ | A..A........ | 0.61 | 47 |
| ..... | ................. | ................. | R..DDR | ...GT..AA.GD | A..A........ | 0.61 | 47 |
| ..... | ................. | ................T | ...N.. | .SAS.N.IA..E | A..A........ | 0.61 | 47 |
| SA... | ................. | ..YN......F......T | R..DDR | .SARTGDTA..G | A..A........ | 0.60 | 46 |
| TA..T | ................. | .PPNG.....F......T | ...DDR | ........... | A..A........ | 0.60 | 46 |
| ..... | ................. | .......NF..P.... | ....D. | ........... | A..A........ | 0.60 | 46 |
| .A..T | F.....SA..SM.M.T.K | .PPNG.....F......T | ...DDR | ........... | A..A........ | 0.60 | 46 |
| NA... | ................. | .QDT.....DF....... | ...N.. | E...RS...F.Q | A..A........ | 0.60 | 46 |
| AT... | F................. | T.HGR....NF......T | ....GR | ........... | A..A........ | 0.60 | 46 |
| ..... | F................. | .V......F....... | ...... | ........... | TSRGG..IT..Q | 0.59 | 45 |
| DA... | ................. | ..AGR....DF......T | R..DG. | .SGGRS..E.DQ | A..A........ | 0.59 | 45 |
| ..... | ................. | TQP.R....NF....... | ....D. | ........... | A..A........ | 0.59 | 45 |
| ..... | ................. | ................. | R..TG. | ........... | A..A........ | 0.57 | 44 |
| .A... | ................. | ..PN.....NF....... | ...DDR | ED.RGS..EVGQ | A..A........ | 0.57 | 44 |
| SA... | F.....SA..SI.M.G.R | .KDSR....DF....... | E..ND. | ESAR..DAA.DD | A..A........ | 0.57 | 44 |
| D...T | F.....DRG.PN.N.N.K | .PPNG.....F......T | ...DDR | ........... | A..A........ | 0.57 | 44 |
| ..... | F................. | .V........F...... | ...... | ........... | NTKNG..NGS.. | 0.56 | 43 |
| NA..T | F.....DHT.R..M.G.R | ................. | ...... | E.AGTADIEVD. | A..A........ | 0.56 | 43 |
| ..... | ................. | ................. | R..DD. | ..GAR.D.E.GE | A..A........ | 0.56 | 43 |
| A.... | ................. | TQ.TG....DF....... | ...DDR | ..AGT.D.EYGQ | A..A........ | 0.56 | 43 |
| .A... | F.....DRG.S..T.A.S | ..DGE....DF....... | ...... | ........... | ........... | 0.56 | 43 |
| E.... | F.....GS..NM.N.T.R | TQDS......NF.....T | ...... | E.TGRA..A..G | A..A........ | 0.56 | 43 |
| A.... | F.....DA..IA.L.K.R | .KDSR....DF......T | R..DD. | ........... | A..A........ | 0.56 | 43 |
| ..... | ................. | ................. | ...A.R | ..ANGND.A..H | A..A........ | 0.56 | 43 |
| ..... | ................. | ................. | ...DD. | ........... | A..A........ | 0.55 | 42 |
| ..... | ................. | ................. | ....G. | ........... | A..A........ | 0.53 | 41 |

TABLE 1-continued

AAV capsid proteins having increased specificity for and/or transduction
of CD133* GSC (pool of Round 1 selection). Amino acid numbers correspond
to the amino acid sequence of VP1 (SEQ ID NO: 1). The percentage value in
the penultimate column indicates the "enrichment factor." Sequences below
correspond to SEQ ID NOs: 8 and 29.295 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ................. | ...D.. | ESARRD.A..DG | A..A........ | 0.53 | 41 |
| E.... | F.....DRG.S..T.A.S | ..DGE....DF....... | ...... | ........... | ........... | 0.53 | 41 |
| SA... | F.....AST.PI.K.Q.K | .KDSR....DF....... | E..ND. | ........... | A..A........ | 0.52 | 40 |
| G...T | F.....DRG.H..L.S.L | .V........F....... | ...... | ........... | A..A........ | 0.52 | 40 |
| ..... | ................. | ................. | R..ND. | EDATEN.I..DR | A..A........ | 0.51 | 39 |
| ..... | ................. | .QD.E.....F..P.... | ...D.. | ........... | ........... | 0.51 | 39 |
| ..... | ................. | TQ.G.....DF....... | ...DDR | .D.R....AFDG | A..A........ | 0.51 | 39 |
| DT... | ................. | .........NF......T | G..K.. | E..G.SD.AF.G | A..A........ | 0.49 | 38 |
| ..... | ................. | .........NF | ...... | E.AG...IAVDR | A..A........ | 0.49 | 38 |
| ..... | ................. | ................. | ...DD. | ...KRA.TE.GE | A..A........ | 0.48 | 37 |
| ..... | F................. | .V........F....... | ...... | ........... | GPSSG...NK.Q | 0.48 | 37 |
| T.... | F.....NG..SN.M...K | .........NF......T | R..AG. | ..GT.DD...DN | A..A..... | 0.47 | 36 |
| A.... | F................. | ..DGE....DF....... | R..DD. | ........... | ........... | 0.46 | 35 |
| ..... | ................. | ................. | E...DR | .SAGAN..E..S | A..A........ | 0.46 | 35 |
| NT..T | F.....ASA.S..T.T.G | .QPG.....DF......T | E..KD. | ........... | ........... | 0.46 | 35 |
| ..... | ................. | ................. | ...... | ........... | A..A........ | 0.46 | 35 |
| AA..T | ................. | ................. | R...D. | .D.TGN.I...Q | A..A........ | 0.44 | 34 |
| ..... | ................. | ..........F....... | R...D. | F..GATG...VD. | A..A........ | 0.44 | 34 |
| NT..T | F................. | .V........DF...... | ...... | ........... | A..A........ | 0.44 | 34 |
| R.... | F......GA.NM.T.A.R | .QPTR....DF....... | E..NG. | .DAG.S.A...E | A..A........ | 0.44 | 34 |
|  | F................. | .V........F....... | ...... | ........... | G.KG...SG..E | 0.44 | 34 |
| .A... | ................. | .........DF......T | ...AG. | E..DRS..EFDN | A..A........ | 0.43 | 33 |
| SA... | F.....NGG.NV.L.N.R | ..DGE....DF....... | ...... | ........... | A..A........ | 0.43 | 33 |
| ....T | F......KT.NV.K.T.H | ..YN......F......T | ...D.R | E..R.N.AEFGE | A..A........ | 0.43 | 33 |
| ..... | ................. | ................. | G..DG. | ........... | ........... | 0.43 | 33 |
| RA... | F.....DTG.SK.T.T.R | .Q.S......F....... | ...D.. | .NGR.G..A..E | A..A........ | 0.43 | 33 |
| AA... | F......DA..IA.M.K.R | T.PTG....DF....... | ...DDR | .NAG.AD.AV.Q | A..A........ | 0.43 | 33 |
| ..... | ................. | ................. | R..D.. | E..A.A....GE | A..A........ | 0.43 | 33 |
| .A... | ................. | ..DGE....DF....... | R..DD. | ........... | ........... | 0.43 | 33 |
| TA... | F.....SKA.S..L.E.R | .Q.S......F....... | R..... | E.GTEGDA..D. | A..A........ | 0.43 | 33 |
| ..... | ................. | ....E....DF......N | R..AGR | E.ATA.DTAV.D | A..A........ | 0.42 | 32 |
| ..... | F................. | .V........F....... | ...... | ........... | TAHSA..ITV.. | 0.42 | 32 |
| ..... | ................. | ................. | ...D.. | E.T..S..A..R | A..A........ | 0.42 | 32 |
| .A... | F.....GKG.NV.I.Q.G | .Q.DH....NF....... | ...DD. | ..TK...AE..D | A..A........ | 0.42 | 32 |
| N.... | F.....GGT.IV.K.G.K | ................. | ...... | ..ARGADAE..S | A..A........ | 0.40 | 31 |
| R.... | F................. | .KPDQ.....F....... | G..ND. | ..TGAS..EV.N | A..A........ | 0.40 | 31 |

TABLE 1-continued

AAV capsid proteins having increased specificity for and/or transduction of CD133* GSC (pool of Round 1 selection). Amino acid numbers correspond to the amino acid sequence of VP1 (SEQ ID NO: 1). The percentage value in the penultimate column indicates the "enrichment factor." Sequences below correspond to SEQ ID NOs: 8 and 29.295 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F................. | .V........F....... | ...... | ............ | S.RSN..FDV.Q | 0.40 | 31 |
| .A..T | F.....SRT..M.K.A.S | .Q.DR.....F....... | ...D.. | ............ | A..A........ | 0.40 | 31 |
| N.... | F.....STG.LQ.L.D.R | .KYT.....NF......T | ...DD. | E.AK.N..AVDG | A..A........ | 0.39 | 30 |
| TA..T | F.....SGA..K.N.S.S | ..HG.....NF......T | ...D.. | ..ADRS...VGS | A..A........ | 0.38 | 29 |
| ..... | ................. | ................. | ...DDR | .DAGRN.IA.DG | A..A........ | 0.38 | 29 |
| .A... | ................. | ..DGE....DF....... | ...... | .DTGAD.IAV.N | A..A........ | 0.38 | 29 |
| .A..T | ......GT..NQ.K.G.R | .KPDQ.....F....... | ...DDR | ..A...AD.E.GG | A..A........ | 0.38 | 29 |
| .A... | F.....NTG.RN.T.T.L | ........NF....... | R...D. | ES.GRGD...DR | A..A........ | 0.38 | 29 |
| EA... | F.....NGG.HV.....L | ..HG.....NF......T | ...D.. | E..GASD.A..Q | A..A........ | 0.36 | 28 |
| G.... | F.....SN..PL.K.T.. | .Q.......DF....... | ...... | .N.AAG..E.GD | A..A........ | 0.36 | 28 |
| ..... | ................. | ................. | R..DD. | ............ | A..A........ | 0.36 | 28 |
| A.... | F.....DR..SL.H.D.R | ..D.E....DF....... | ...DD. | E.GR.DD.E.GE | A..A........ | 0.34 | 26 |
| ..... | ................. | ................. | R...DR | E.T..S..A..R | A..A........ | 0.34 | 26 |
| ..... | ................. | ................. | ...... | ENTDAS.A...N | A..A........ | 0.34 | 26 |
| ..... | ................. | ................. | ...DG. | ..ASE..AAYDS | A..A........ | 0.34 | 26 |
| ..... | F................. | .V........F....... | ...... | ............ | SRQNG..APT.. | 0.34 | 26 |
| TT..T | F.....S...PN.T.G.V | .Q.GQ....DF....... | ...D.. | ............ | A..A........ | 0.34 | 26 |
| ..... | ................. | ................. | R..DD. | ............ | A..A........ | 0.33 | 2 |
| E.... | ................. | .Q.S.....NF....... | R..DD. | ENAAES.IE.GR | A..A........ | 0.33 | 2 |
| G.... | F.....GHA.SK.T.E.K | .QPSQ....NF....... | R...D. | ............ | A..A........ | 0.33 | 2 |
| SA... | ................. | .........NF....... | ...TG. | E.AGGS..AVDG | A..A........ | 0.31 | 24 |
| ..... | ................. | ................. | R..AGR | ............ | A..A........ | 0.30 | 23 |
| ..... | ................. | ................. | G..KGR | ............ | A..A........ | 0.30 | 23 |
| ..... | ................. | .Q.DR.....F....... | ...D.. | E.TD.A....DG | A..A........ | 0.30 | 23 |
| .A... | F................. | ................. | ...D.. | E..AGS.AA.DN | A..A........ | 0.30 | 23 |
| ..... | F....ASA.S...T.T.G | .QPG.....DF....... | ...DDR | ............ | ............ | 0.30 | 23 |
| ..... | F....NR..N..I.T.G | ..DGE....DF....... | ...... | ............ | A..A........ | 0.30 | 23 |
| ..... | ................. | .Q.DR.....F....... | ...D.. | ............ | A..A........ | 0.30 | 23 |
| S.... | ................. | .........NF....... | R...D. | .SASGND..FD. | A..A........ | 0.29 | 23 |
| AA..T | ................. | .QPG.....NF......T | ...DDR | ENGTEN..A.D. | A..A........ | 0.29 | 22 |
| ..... | F................. | .V........F....... | ...... | ............ | KPKNG..NHE.Q | 0.29 | 22 |
| ..... | ................. | ................. | R...D. | .D.TGN.I...Q | A..A........ | 0.27 | 22 |
| ..... | ................. | .........DF....... | G..KGR | E.ASTSD.A.DH | A..A........ | 0.27 | 21 |
| NT..T | ................. | ................. | ...... | ............ | ............ | 0.26 | 21 |
| H.... | F.....ATG.NN.I.S.G | TQPTH....NF....... | R..DD. | ............ | A..A........ | 0.26 | 20 |

TABLE 1-continued

AAV capsid proteins having increased specificity for and/or transduction
of CD133* GSC (pool of Round 1 selection). Amino acid numbers correspond
to the amino acid sequence of VP1 (SEQ ID NO: 1). The percentage value in
the penultimate column indicates the "enrichment factor." Sequences below
correspond to SEQ ID NOs: 8 and 29.295 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| SA... | F.....SAT.PV.T.Q.G | ..AGR....DF......T | R.D... | ............ | A..A........ | 0.26 | 20 |
| SA... | F.....GTG.S..H.T.N | .Q.GQ....DF....... | ...G.. | E..G...D.AVGE | A..A........ | 0.26 | 20 |
| G.... | ......GKG.S..M.K.M | T.PGG....NF....... | ...DD. | .D.G.D..AF.Q | A..A........ | 0.26 | 20 |
| ..... | F................. | .V........F....... | ...... | ............ | GTKGS..IEN.. | 0.25 | 20 |
| R.... | ................. | .QHTH....NF......T | G..DD. | ............ | A..A........ | 0.25 | 19 |
| .A..T | F.....GT..NQ.K.G.R | .KPDQ.....F....... | ...DDR | ..A..AD.E.GG | A..A........ | 0.25 | 19 |
| ..... | ................. | .........NF....... | R..DD. | E.AG..D.A.GR | A..A........ | 0.25 | 19 |
| .A..T | F.....ASA.S..T.T.G | .QPG.....DF......T | E..KD. | ............ | ............ | 0.23 | 18 |
| RA... | ................. | .QPTG....NF....... | R..D.R | ES.S.SDAE..E | A..A........ | 0.23 | 18 |
| ..... | .............L... | ..DD.....DF....... | E..DD. | ..AGAD...FDG | A..A........ | 0.23 | 18 |
| G.... | F.....SRA.SK.N.A.H | .Q.......DF....... | ...AD. | ..AARS..AF.Q | A..A........ | 0.23 | 18 |
| ..... | ................. | ................. | ...D.. | E.TAEN...FDD | A..A........ | 0.22 | 17 |
| AA... | F.....DA..IA.L.K.R | T.PTG....DF...... | ...DDR | .NAG.AD.AV.Q | A..A........ | 0.22 | 17 |
| ..... | ................. | ................. | ...DD. | ...GEA..EF.G | A..A........ | 0.22 | 17 |
| A.... | F.....DA..IA.L.K.R | .KDSR....DF......T | R..DG. | ............ | A..A........ | 0.22 | 17 |
| ..... | F................. | .V........F....... | ...... | ............ | T.RNT..ASG.E | 0.22 | 17 |
| GA... | ................. | .Q.GQ....DF....... | ....GR | ESAKTADAAVDD | A..A........ | 0.21 | 16 |
| ..... | ................. | ................. | ...... | EDGGG..IE.D. | A..A........ | 0.21 | 16 |
| NT..T | ......DRG.S..T.A.S | ..DGE....DF....... | ...... | ............ | ............ | 0.21 | 16 |
| ..... | ................. | ................. | ....D. | E.GAT.DAE.DR | A..A........ | 0.20 | 15 |
| ..... | ................. | .........DF....... | G..DD. | ED.NGN.IA.D. | A..A........ | 0.18 | 14 |
| ..... | F.....DA..IA.L.K.R | .KDSR....DF......T | R..DD. | ............ | A..A........ | 0.17 | 13 |
| DA... | F......NG.LQ.H...N | T.P......DF....... | ...D.. | ............ | ............ | 0.17 | 13 |
| NT..T | F.....ASA.S..T.T.G | .QPG.....DF....... | ...DDR | ............ | A..A........ | 0.17 | 13 |
| H.... | F.....DK..NV.T.G.R | ...DG....DF....... | ...... | .NAAG.DI.VD. | A..A........ | 0.17 | 13 |
| ..... | ................. | ................. | ....G. | E.AAGSD.EVDR | A..A........ | 0.16 | 12 |
| ..... | ................. | ....E....DF....T | ...D.. | .NA.RA.T..G. | A..A........ | 0.16 | 12 |
| DT... | F......KT.NK...A.G | ..HG.....NF......T | ...D.. | ............ | A..A........ | 0.16 | 12 |
| G.... | F.....DHT.NI.M.T.S | .QPSQ....NF....... | R..DD. | ............ | A..A........ | 0.16 | 12 |
| G.... | ................. | .QDT.....DF....... | G..DG. | ............ | ............ | 0.16 | 12 |
| ..... | ........E........ | ................. | R..DD. | ............ | A..A........ | 0.16 | 12 |
| ..... | ................. | ....E....DF....... | R..AGR | E.ATA.DTAV.D | A..A........ | 0.14 | 11 |
| RT... | ................. | .QPN.....DF......T | R..TG. | ............ | A..A........ | 0.14 | 11 |
| ..... | F................. | .V........F....... | ...... | ............ | SHRTG..SNE.T | 0.14 | 11 |
| ..... | ................. | ................. | ....G. | ..AA.D.IA... | A..A........ | 0.14 | 11 |
| ..... | F................. | .V........F....... | ...... | ............ | A..A........ | 0.14 | 11 |

TABLE 1-continued

AAV capsid proteins having increased specificity for and/or transduction of CD133* GSC (pool of Round 1 selection). Amino acid numbers correspond to the amino acid sequence of VP1 (SEQ ID NO: 1). The percentage value in the penultimate column indicates the "enrichment factor." Sequences below correspond to SEQ ID NOs: 8 and 29.295 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | .................. | ...DDR | E.ADRSD...GN | A..A........ | 0.14 | 11 |
| NT..T | F.....AEG.LK.M.H.L | .KPDQ....DF....... | ...DDR | ............ | ............ | 0.13 | 11 |
| ..... | .................. | ...............T | E..AD. | .NADRN..E.GE | A..A........ | 0.13 | 10 |
| SA... | .................. | ..HG.....NF....... | ...TD. | .NATG....VGS | A..A........ | 0.13 | 10 |
| R.... | F.....GGG....K.G.R | .................. | ...... | ...AAS.A.VGQ | A..A........ | 0.13 | 10 |
| ..... | .................. | .................. | E...G. | ENATRGDIA..D | A..A........ | 0.12 | 10 |
| ..... | .................. | .................. | ...N.. | EDTSRGD.E... | A..A........ | 0.12 | 9 |
| ..... | .................. | .........NF....... | ...A.. | .S.RT...A.DD | A..A........ | 0.12 | 9 |
| A.... | F.....GKA.SE.N...K | .................. | ...D.. | E.GG.N.I.V.G | A..A........ | 0.12 | 9 |
| SA... | F.....ST...N...A.K | T.P......DF....... | ...D.. | ............ | ............ | 0.12 | 9 |
| ..... | .................. | TKDDR....DF....... | ...DDR | E.AG.S..E.DN | A..A........ | 0.10 | 9 |
| ..... | .................. | .................. | ...D.. | E.TR.M.....Q | A..A........ | 0.10 | 8 |
| ..... | .................. | .................. | E..ND. | ............ | ............ | 0.09 | 8 |
| ..... | .................. | .........DF....... | ...D.. | ..AAGSDTA.DE | A..A........ | 0.09 | 7 |
| E.... | F.....GT..NQ.K.G.R | T.PTR....DF....... | R...D. | ............ | A..A........ | 0.09 | 7 |
| ..... | F.....NGT.L..M.K.R | ..YN......F......T | ...... | ESGTAND...DR | A..A........ | 0.09 | 7 |
| ..... | .................. | .................. | ...... | .DAAGA.IE.GN | A..A........ | 0.09 | 7 |
| SA... | .................. | .KD.E.....F..P...T | R..ND. | ............ | A..A........ | 0.09 | 7 |
| ..... | .................. | .................. | ...DDR | E..NG.DI..D. | A..A........ | 0.09 | 7 |
| ..... | F................. | .V........F....... | ...... | ............ | DRRG...S.A.H | 0.09 | 7 |
| N...T | F......KT.NV.K.T.H | T.P......DF....... | ....GR | ............ | A..A........ | 0.08 | 6 |
| NT..T | F......KG.RV.T.A.G | ...TE.....F......T | ...NGR | .SAKAA.AA.DE | A..A........ | 0.08 | 6 |
| GA..T | .................. | .KYT......F....... | G..KD. | E.AGTSD.AFGE | A..A........ | 0.08 | 6 |
| E.... | .................. | ..HG.....NF....... | ...TD. | .NATG....VGS | A..A........ | 0.08 | 6 |
| RT... | F.....ATT.NV.T.K.S | T.A.Q....DF....... | G..A.R | E.ANG..AE.GE | A..A........ | 0.08 | 6 |
| TA... | .................. | .QANH....DF....... | ...DDR | ............ | A..A........ | 0.07 | 5 |
| ..... | F................. | .V........F....... | ...... | ............ | TRSAP..FNT.E | 0.07 | 5 |
| SA... | .................. | ..YN......F......T | ...D.R | ............ | A..A........ | 0.07 | 5 |
| ..... | F.....NGG.NN.K.T.R | .QPSE....DF....... | ....GR | ES.G.S.IAV.G | A..A........ | 0.07 | 5 |
| S.... | F.....SRA.SK.N.A.H | T.P......DF....... | ...D.. | ..TR.ND.A.DE | A..A........ | 0.07 | 5 |
| ..... | .................. | .PPNG.....F......T | ...DDR | E.ATRA..A.DE | A..A........ | 0.07 | 5 |
| ..... | .................. | ..DGG....DF....... | ...... | ED.R.N..AY.G | A..A........ | 0.05 | 4 |
| A.... | F.....DHT.SQ.L...K | .KYT.....NF......T | E..TD. | ............ | A..A........ | 0.05 | 4 |
| ..... | .................. | .................. | ...... | E.ATAS.AAFDE | A..A........ | 0.05 | 4 |
| ..... | F................. | .V........F....... | ...... | ............ | TAQA....GA.D | 0.05 | 4 |

TABLE 1-continued

AAV capsid proteins having increased specificity for and/or transduction
of CD133* GSC (pool of Round 1 selection). Amino acid numbers correspond
to the amino acid sequence of VP1 (SEQ ID NO: 1). The percentage value in
the penultimate column indicates the "enrichment factor." Sequences below
correspond to SEQ ID NOs: 8 and 29.295 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F................. | .V........F....... | ...... | ............ | D.RAA..N...A | 0.05 | 4 |
| ..... | .................. | .........DF....... | ...TG. | ..ASGD....GR | A..A........ | 0.05 | 4 |
| E.... | F.....AEG.LK.M.H.L | ..DGE....DF....... | ...... | ............ | ............ | 0.05 | 4 |
| ..... | .................. | .................. | R..DD. | .NGST.....GG | A..A........ | 0.04 | 4 |
| E.... | F................. | .QPG.....DF....... | ...DDR | ............ | ............ | 0.04 | 3 |
| ..... | .................. | .................. | ...... | ESANGNDIE..D | A..A........ | 0.04 | 3 |
| .A... | F......R..PN.T.A.M | T..NE....DF....... | ...D.. | ..AGGN..E.GG | A..A........ | 0.04 | 3 |
| NA..T | F................. | .V........F....... | ...... | ............ | GTRT...Y.M.Q | 0.04 | 3 |
| NA..T | F.....ASA.S..T.T.G | .QPG.....DF....... | ...DDR | ............ | ............ | 0.04 | 3 |
| ..... | .................. | .................. | ...DDR | E.GATG...VD. | A..A.......D | 0.03 | 2 |
| TA..T | F................. | .QD......DF..P.... | G..K.. | ............ | A..A........ | 0.03 | 2 |
| ....T | F......KT.NV.K.T.H | ..YN......F......T | ...D.R | E..R.N.SEFGE | A..A........ | 0.03 | 2 |
| ..... | .................. | .........DF....... | ...DDR | ...GTSDI.VGQ | A..A........ | 0.03 | 2 |
| ..... | F................. | .V........F....... | ...... | ............ | GQKSR..VEA.T | 0.03 | 2 |
| N.... | F.....STG.LQ.L.D.R | .KYT.....NF......T | E..DD. | E.AK.N..AVDG | A..A........ | 0.03 | 2 |
| .A..T | F.....SA..SM.M.T.K | .PPNG.....F......T | ...DDR | ............ | A..A.......K | 0.03 | 2 |
| ..... | F................. | .V........F....... | ...... | ............ | GTRT...Y.M.Q | 0.03 | 2 |
| TA... | .................. | TQYDR....NF....... | ...DDR | ............ | A..A........ | 0.03 | 2 |
| ..... | ..............R.... | .................. | ...DD. | ............ | A..A........ | 0.03 | 2 |
| TA... | F.....SKA.S..L.E.R | .Q.S......F....... | G..... | E.GTEGDA..D. | A..A........ | 0.03 | 2 |
| ..... | .................. | ..DGE....DF....... | ...... | F...STG.IAY.D | A..A........ | 0.03 | 2 |
| RT... | .................. | TKDDR....DF....... | ...DDR | ............ | A..A........ | 0.03 | 2 |
| ..... | .................. | .................. | R..D.R | ..TNESD..... | A..A........ | 0.03 | 2 |
| ..... | .................. | .QDT.....DF....... | G..DG. | ............ | ............ | 0.03 | 2 |
| ..... | .................. | .................. | R..... | .NGDTG....GG | A..A........ | 0.03 | 2 |
| E.... | F.....NTT..V.N.K.R | ..DD.....DL....... | E..DD. | ............ | A..A........ | 0.03 | 2 |
| ..... | .................. | .........DF....... | ...D.. | E.TTRSDIE.DR | A..A........ | 0.03 | 2 |
| ..... | .................. | SQ.G.....DF....... | ...DDR | .D.R....AFDG | A..A........ | 0.01 | 1 |
| ..... | F.....NA..RM.M.K.. | .Q.S......F....... | E.N... | ............ | A..A........ | 0.01 | 1 |
| SA... | ......NGG.NV.L.N.R | .................. | ...DDR | .DAGRN.IA.DG | A..A........ | 0.01 | 1 |
| ..... | .................. | TKDDR....DF....... | ...DDR | ............ | A..A........ | 0.01 | 1 |
| ..... | F.....GG..SL.L...M | ..DGE....DF....... | ...... | ES.DRN.....Q | A..A........ | 0.01 | 1 |
| ..... | .................. | .................. | E..DD. | ............ | A..A........ | 0.01 | 1 |
| ..... | .................. | .................. | ...N.R | .NAT.D.TAY.S | A..A........ | 0.01 | 1 |
| NT... | F.....DQT.PL.T...R | ..AGQ....NF....... | ...D.. | .DGGGAD.A.D. | A..A........ | 0.01 | 1 |
| ..... | F................. | .V........F....... | ...... | ....E....... | TSRGG..TT..Q | 0.01 | 1 |

TABLE 1-continued

AAV capsid proteins having increased specificity for and/or transduction of CD133* GSC (pool of Round 1 selection). Amino acid numbers correspond to the amino acid sequence of VP1 (SEQ ID NO: 1). The percentage value in the penultimate column indicates the "enrichment factor." Sequences below correspond to SEQ ID NOs: 8 and 29.295 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | .........NF....... | ...... | E.AG...IAVDR | A..A......I. | 0.01 | 1 |
| ..... | F................. | .V........F....... | ...... | ............ | KP.GP..V.M.. | 0.01 | 1 |
| ..... | ................. | TQ.TG.....F....... | ...DDR | ..AGT.D.EYGQ | A..A........ | 0.01 | 1 |
| NA... | ................. | .RDT.....DF....... | ...N.. | E...RS...F.Q | A..A........ | 0.01 | 1 |
| ..... | ................. | ................. | R..... | ............ | A..A........ | 0.01 | 1 |
| GT... | F.....AEG.LK.M.H.L | ..DGE....DF....... | .....S | ............ | ............ | 0.01 | 1 |
| ..... | ................. | ................. | .....S | EDGGG..IE.D. | A..A........ | 0.01 | 1 |
| ..... | ................. | ..YN......F......T | ...N.. | ............ | A..A........ | 0.01 | 1 |
| .A..T | ......GT..NQ.K.G.R | .KPDQS....F....... | ...DDR | ..A..AD.E.GG | A..A........ | 0.01 | 1 |
| ....A | ................. | ................. | ....D. | ............ | A..A........ | 0.01 | 1 |
| .A... | ................. | TP.DG....NF....... | ...DDR | ............ | A..A........ | 0.01 | 1 |
| ..... | ................. | ..AD.....DF......T | ...DG. | EN.ARG..E..R | A..A........ | 0.01 | 1 |
| NT..T | F......KG.RV.T.A.G | ...TE.....F......T | ...NGR | .SAKAA.AA.DE | ............ | 0.01 | 1 |
| ..... | ................. | ................. | ...DDR | .RRR...IAYGN | A..A........ | 0.01 | 1 |
| AA... | F.....G.G.HM.M.S.M | T.P......DF....... | ...D.. | H........... | A..A........ | 0.01 | 1 |
| D...T | F......KT.NK...A.G | .V........F....... | ...... | .S.ARGDI..DN | A..A........ | 0.01 | 1 |
| AA... | ................. | TQ..N....NF....... | ...... | ............ | A..A........ | 0.01 | 1 |
| ..... | F................. | .V........F....... | .....S | ............ | G.KG...SG..E | 0.01 | 1 |

TABLE 2

AAV capsid proteins having increased specificity for and/or transduction of CD133+ GSC (pool of Round 2 selection). Amino acid numbers correspond to the amino acid sequence of VP1 (SEQ ID NO: 1). Sequences below correspond to SEQ ID NOs: 8 and 296.523 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ................. | R..... | ............ | A..A........ | 18.79 | 1309 |
| GT... | F.....AEG.LK.M.H.L | ..DGE....DF....... | ...... | ............ | ............ | 3.45 | 240 |
| ..... | F................. | .QAS......F....... | R..ND. | ............ | A..A........ | 2.63 | 183 |
| ..... | ................. | ................. | ...... | ............ | A..A........ | 2.51 | 175 |
| ..... | F.....ASA.S..T.T.G | .QPG.....DF....... | ...DDR | ............ | ............ | 2.30 | 160 |
| ..... | ................. | .QD.E.....F..P.... | ...D.. | ............ | ............ | 2.10 | 146 |
| ..... | ................. | ................. | ...D.. | ............ | ............ | 2.08 | 145 |
| ..... | F.....AEG.LK.M.H.L | ..DGE....DF....... | ...... | ............ | ............ | 1.94 | 135 |
| ..... | ................. | ................. | ...D.. | .NATG....VGS | A..A........ | 1.62 | 113 |
| ..... | ................. | ................. | R..DD. | ............ | A..A........ | 1.29 | 90 |
| AA... | F.....DRG.S..T.A.S | ..DGE....DF....... | ...... | ............ | ............ | 1.26 | 88 |

TABLE 2-continued

AAV capsid proteins having increased specificity for and/or transduction of CD133+ GSC (pool of Round 2 selection). Amino acid numbers correspond to the amino acid sequence of VP1 (SEQ ID NO: 1). Sequences below correspond to SEQ ID NOs: 8 and 296.523 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F.....SGT.S..T.T.. | TQ.S.....DF....... | R..DD. | E..TAA.AAFDE | A..A........ | 1.19 | 83 |
| ..... | ................. | .................. | ...DDR | ............ | A..A........ | 1.13 | 79 |
| ..... | F................. | .V........F....... | ...... | ............ | KTKNP...GE.H | 1.13 | 79 |
| ..... | ................. | .................. | R..AD. | ............ | A..A........ | 1.00 | 70 |
| ..... | F................. | ..DGE....DF...R. | ...D.. | ............ | ............ | 0.95 | 66 |
| GA... | F.....ASA.S..T.T.G | .QPG.....DF....... | ...DDR | ............ | A..A........ | 0.89 | 62 |
| E.... | F.....ASA.S..T.T.G | .QPG.....DF....... | ...DDR | ............ | A..A........ | 0.88 | 61 |
| ..... | ................. | T.HTE....NF..T.... | ...NDR | ............ | A..A........ | 0.88 | 61 |
| ..... | ................. | .................. | G..N.. | ............ | ............ | 0.86 | 60 |
| D.... | F.....GQG.IA.....K | .................. | ...... | ............ | A..A........ | 0.83 | 58 |
| ..... | ................. | .................. | ...D.. | .STGAD...... | A..A........ | 0.79 | 55 |
| SA... | F.....ASA.S..T.T.G | .Q.S......F....... | ....D. | ............ | ............ | 0.76 | 53 |
| A.... | ................. | .................. | ...N.. | ...G.N.A.... | A..A........ | 0.75 | 52 |
| AT... | ................. | .Q.G.....NF....... | ...DDR | ............ | A..A........ | 0.75 | 52 |
| .A... | ................. | .................. | ...D.. | ............ | ............ | 0.75 | 52 |
| TA... | F.....DGA.R..P.A.K | ..YN......F......T | R..DD. | ............ | A..A........ | 0.75 | 52 |
| ..... | ................. | .................. | ...... | .SAT.N.IA..H | A..A........ | 0.75 | 52 |
| ..... | ................. | .................. | ...... | GDTTGS.AA..E | A..A........ | 0.75 | 52 |
| ..... | ................. | .V........F....... | ...... | ............ | TARSA..VDG.A | 0.73 | 51 |
| ..... | ................. | .................. | G..DD. | EDAG.AD.E..R | ............ | 0.72 | 50 |
| E.... | F.....GAT.IN.M.K.L | T.ANE....DF....... | ...DDR | ............ | ............ | 0.70 | 49 |
| ..... | ................. | .................. | R..DD. | ............ | ............ | 0.70 | 49 |
| ..... | ................. | .V........F....... | ...... | ............ | GR.DT..FTE.D | 0.70 | 49 |
| ..... | F................. | .V........F....... | ...... | ............ | SRHNE..S.V.Q | 0.69 | 48 |
| ..... | ................. | .................. | ...DDR | .NAAAN..EF.H | A..A........ | 0.69 | 48 |
| GT... | ................. | .PDNR..T.DF......T | ....GR | ............ | A..A........ | 0.69 | 48 |
| TT..T | ................. | .........DF.P....T | ...AD. | ............ | A..A........ | 0.69 | 48 |
| ..... | ................. | .................. | E..N.. | E.ATAS.AAFDE | A..A........ | 0.67 | 47 |
| DT... | ....AST.IN.L.T.. | ..DGE....DF....... | ...... | ............ | ............ | 0.67 | 47 |
| ..... | ................. | .........F....... | R..AD. | .NAR.A.I..GE | A..A........ | 0.65 | 45 |
| ST... | ............T.N | .................. | ...... | ..TG.D..A.GG | A..A........ | 0.63 | 44 |
| GA..T | P.....SNG.P....T.R | ..A......DF....... | ...DG. | ............ | A..A........ | 0.63 | 44 |
| ..... | F.....GG..SL.L...M | ..DGE....DF....... | ...... | ES.DRN.....Q | A..A........ | 0.62 | 43 |
| ..... | ................. | .................. | R..DD. | ES.DRN..A.DN | A..A........ | 0.60 | 42 |
| ..... | ................. | .................. | ....GR | EDAGT..AA..H | A..A........ | 0.60 | 42 |
| ..... | ................. | .................. | ...... | ............ | A..A........ | 0.60 | 42 |
| ..... | F................. | .V........F....... | ...... | ............ | GPRTA...SG.H | 0.60 | 42 |

TABLE 2-continued

AAV capsid proteins having increased specificity for and/or transduction of CD133+ GSC (pool of Round 2 selection). Amino acid numbers correspond to the amino acid sequence of VP1 (SEQ ID NO: 1). Sequences below correspond to SEQ ID NOs: 8 and 296.523 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F................. | .V.......F....... | ...... | ............ | GTRDG..AE..A | 0.60 | 42 |
| NT... | ................. | ..YN......F......T | .N.D.R | ............ | A..A........ | 0.59 | 41 |
| ..... | ................. | ................. | ...... | EDANG...EV.N | A..A........ | 0.59 | 41 |
| ..... | ................. | .V.......F....... | ...... | ............ | NPRDK..FEG.. | 0.57 | 40 |
| ..... | ................. | ................. | R..D.. | ............ | A..A........ | 0.56 | 39 |
| ..... | F................. | .V.......F....... | ...... | ............ | DQRGT...RG.D | 0.56 | 39 |
| ..... | .........SP.H.E.V | ..HG.....NF......T | ...DDR | E.AGAND.AV.H | A..A........ | 0.56 | 39 |
| ..... | F................. | .V.......F....... | ...... | ............ | GARGG..FNM.Q | 0.56 | 39 |
| T...T | ................. | ..A......DF....... | ...DG. | EDAGT...AFD. | A..A........ | 0.56 | 39 |
| HA... | F.....GKT.SL...G.R | ..A......DF....... | ...DG. | ENANGN.IAFD. | A..A........ | 0.55 | 38 |
| ..... | F................. | .V.......F....... | ...... | ............ | ERSGA..IE..D | 0.55 | 38 |
| G.... | ................. | .V.......F....... | ...... | ............ | A..A........ | 0.52 | 36 |
| ..... | F................. | .V.......F....... | ...... | ............ | .EKGG...QN.. | 0.50 | 35 |
| ..... | ................. | ................. | ...... | E.AG.S...... | A..A........ | 0.50 | 35 |
| .A... | F.....ASA.S..T.T.G | .QPG.....DF....... | ...DDR | ............ | ............ | 0.49 | 34 |
| ..... | ................. | ................. | ....GR | ..ARRGD.A.DE | A..A........ | 0.49 | 34 |
| G.... | ................. | .........NF....... | R...D. | ............ | A..A........ | 0.49 | 34 |
| ..... | F................. | .V.......F....... | ...... | ............ | NQHNA..FQT.P | 0.49 | 34 |
| H.... | F................. | ................. | ...DDR | ............ | A..A........ | 0.47 | 33 |
| .A... | F.....DAA.IK.T.Q.N | ..DGE....DF....... | ...... | E........... | ............ | 0.47 | 33 |
| .A... | F.....DRG.S..T.A.S | ..DGE....DF....... | ...... | ............ | ............ | 0.46 | 32 |
| AA... | F.....SG..IK.K.D.R | ..P.E....NF......T | E..DG. | E.GAR..AA..Q | A..A........ | 0.45 | 31 |
| ..... | ................. | ................. | ...... | ............ | DHRNP..DQA.. | 0.43 | 30 |
| ..... | ................. | ................. | R...D. | ............ | A..A........ | 0.43 | 30 |
| TA... | ................. | .QANH....DF....... | ...DDR | ............ | A..A........ | 0.43 | 30 |
| ..... | F................. | .Q.GQ....DF....... | ....G. | EDAGRN...V.N | A..A........ | 0.42 | 29 |
| TA..T | F.....GDG....K.Q.R | .V.......F....... | ...DDR | .SAKAA.AA.DE | A..A........ | 0.42 | 29 |
| ..... | ................. | ................. | ...D.. | ...G.D..EVGQ | A..A........ | 0.42 | 29 |
| ..... | ................. | ................. | R..D.. | ..ASAAD.E..D | A..A........ | 0.40 | 28 |
| EA... | ................. | ................. | ..ND.. | ..ATT..T.F.Q | A..A........ | 0.40 | 28 |
| ..... | ................. | ..DNH....NF......T | E..ND. | ............ | A..A........ | 0.40 | 28 |
| ..... | ................. | ................. | ...DD | E.AGGN..E.DD | A..A........ | 0.36 | 25 |
| ..... | F................. | .V.......F....... | ...... | ............ | TARTA..SQV.H | 0.36 | 25 |
| ..... | ................. | ................. | G..KD. | ESAGAN....GG | A..A........ | 0.36 | 25 |
| ....T | ................. | ................. | ...... | ............ | ............ | 0.36 | 25 |
| ..... | ................. | ................. | R..ND. | ..AGEN..A..G | A..A........ | 0.34 | 24 |

TABLE 2-continued

AAV capsid proteins having increased specificity for and/or transduction of CD133+ GSC (pool of Round 2 selection). Amino acid numbers correspond to the amino acid sequence of VP1 (SEQ ID NO: 1). Sequences below correspond to SEQ ID NOs: 8 and 296.523 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| RA... | ................. | .................... | ...AG. | ........... | A........... | 0.33 | 23 |
| ..... | ...........M..... | .................... | ...NDR | ..AKG...AV.. | A..A........ | 0.33 | 23 |
| R...T | ................. | .V........F....... | E..TD. | ........... | ........... | 0.33 | 23 |
| ..... | F................ | .V........F....... | ...... | ........... | GPKNP..DRT.D | 0.32 | 22 |
| ..... | F................ | .V........F....... | ...... | ........... | DSRGG..FSE.. | 0.32 | 22 |
| EA... | F.....DAA.IK.T.Q.N | ..DGE....DF....... | ...... | E.......... | ........... | 0.30 | 21 |
| ..... | ......GN..IK.L...G | .QAS......F....... | ...... | ........... | A..A........ | 0.29 | 20 |
| E.... | F.....DRG.S..T.A.S | ..DGE....DF....... | ...... | ........... | ........... | 0.29 | 20 |
| ..... | ...............T.N | .................... | ...... | ..TG.D..A.GG | A..A........ | 0.27 | 19 |
| E.... | ................. | .................... | R...D. | .DAKGD.A.F.D | A..A........ | 0.27 | 19 |
| GT... | F.....AEG.LK.M.H.L | ..DGE....DF....... | ...DDR | ........... | A..A........ | 0.27 | 19 |
| ..... | F......AG.NP.P.D.R | .QAS.....NF....... | ...... | ........... | A..A........ | 0.26 | 18 |
| ..... | ................. | ..P.G....NF....... | R...D. | R..NG....VDG | A..A........ | 0.26 | 18 |
| GT... | ................. | ..HG.....NF......T | E..DD. | ........... | ........... | 0.26 | 18 |
| ..... | ................. | .................... | R..A.. | ........... | A..A........ | 0.26 | 18 |
| TT..T | ................. | .................... | ...... | ........... | ........... | 0.26 | 18 |
| .A..T | P.....ASA.S..T.T.G | .QPG.....DF......T | F..KD. | ........... | ........... | 0.24 | 17 |
| ..... | F................ | .V.V......F....... | ...... | ........... | GARAT..SQ... | 0.23 | 16 |
| ..... | F.....NGG.NV.L.N.R | ..DGE....DF....... | ...... | ........... | A..A........ | 0.23 | 16 |
| ..... | ................. | ..AGR....DF....... | ...D.. | .NAG.DD...DQ | A..A........ | 0.23 | 16 |
| ..... | ................. | .................... | R...D. | E.AG..D.A.GR | A..A........ | 0.22 | 15 |
| ..... | ................. | .........DF....... | ...D.. | E.ASGG.A..GS | A..A........ | 0.22 | 15 |
| ..... | ................. | .................... | ...N.. | E..G.SDAA.GD | ...A........ | 0.20 | 14 |
| SA... | ................. | .QAS......F....... | ...... | E.TNAA.I.FDR | A..A........ | 0.20 | 14 |
| A.... | ................. | .................... | ...D.R | ESATGG.T..GG | A..A........ | 0.20 | 14 |
| AT... | F.....ATG.NV.T.G.R | ..HDG.....F....... | ...... | ........... | A..A........ | 0.20 | 14 |
| ..... | ................. | .................... | R..DD | ESGGAD.I...R | A..A........ | 0.19 | 13 |
| ..... | ................. | .................... | ...D.. | .SG.TN.T..D. | A..A........ | 0.19 | 13 |
| ..... | ................. | .................T | R..D.R | ........... | A..A........ | 0.19 | 13 |
| ..... | F................ | .V........F....... | ...... | ........... | TRRDG..I.S.E | 0.19 | 13 |
| ..... | ................. | .................... | R..D.R | E.AAAA.I..D. | A..A........ | 0.19 | 13 |
| ..... | ................. | .QANH....DF....... | ...DDR | ........... | ........... | 0.19 | 13 |
| ..... | ................. | .................... | ...D.. | E.AGAND.AY.N | A..A........ | 0.17 | 12 |
| ..... | ................. | .................... | ...TG. | .SAKAA.AA.DE | A..A........ | 0.17 | 12 |
| ..... | F................ | .V........F....... | ...... | ........... | AQRAG..VDA.Q | 0.17 | 12 |
| D...T | F................ | .Q.S......F....... | ...... | ........... | ........... | 0.17 | 12 |
| ..... | F................ | .V........F....... | ...... | ........... | TERGT..SD... | 0.17 | 12 |

TABLE 2-continued

AAV capsid proteins having increased specificity for and/or transduction of CD133+ GSC (pool of Round 2 selection). Amino acid numbers correspond to the amino acid sequence of VP1 (SEQ ID NO: 1). Sequences below correspond to SEQ ID NOs: 8 and 296.523 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | .................. | R..AGR | ........... | A..A........ | 0.16 | 11 |
| AA..T | ................. | .................. | R...D. | .D.TGN.I...Q | A..A........ | 0.16 | 11 |
| ..... | F................ | .V........F....... | ...... | ........... | GTRST..FRE.T | 0.16 | 11 |
| ..... | F................ | .V........F....... | ...... | .SADGSD...DR | A..A........ | 0.14 | 10 |
| ..... | ................. | .................. | ...D.. | .SAGRGDAAVDE | A..A........ | 0.14 | 10 |
| ..... | ................. | .................. | ...DD. | .NGST.....GG | A..A........ | 0.14 | 10 |
| ..... | F................ | .V........F....... | ...... | ........... | SQRAS..SDK.D | 0.14 | 10 |
| ..... | ................. | .................. | R..... | ........... | ........... | 0.14 | 10 |
| GT... | F......KG.NL...Q.S | .QPG.....NF....... | ...DDR | ........... | A..A........ | 0.13 | 9 |
| ..... | ................. | .................. | ...... | .NGGAADAE..H | A..A........ | 0.13 | 9 |
| HT... | F.....NTG.HP.T.G.M | T.P......DF....... | ...D.. | ........... | ........... | 0.13 | 9 |
| RT... | ................. | .................. | G..A.R | ........... | A..A........ | 0.13 | 9 |
| A.... | ................. | .QD.E....F..P..... | ...D.. | ........... | ........... | 0.13 | 9 |
| ..... | F................ | .V........F....... | ...... | ........... | GRQDS..NR..E | 0.13 | 9 |
| GT... | ................. | .KYT.....DF....... | G..KGR | .DAS.N...VDG | A..A........ | 0.13 | 9 |
| ..... | ................. | .................. | ...... | ESAN...I...H | A..A........ | 0.11 | 8 |
| ..... | ................. | .................. | ....D. | ........... | ...A........ | 0.11 | 8 |
| TA... | F................ | .V........F....... | ...... | ........... | AK.TE...G... | 0.11 | 8 |
| ..... | ................. | .................. | ...D.R | ESATGG.T..GG | A..A........ | 0.11 | 8 |
| ..... | ................. | .................. | R..TG. | ........... | A..A........ | 0.10 | 7 |
| ..... | F................ | .V........F....... | ...... | ........... | GKRD...AGE.K | 0.10 | 7 |
| ..... | ................. | .................. | ...N.. | E..TAA.AAFDE | A..A........ | 0.10 | 7 |
| ..... | F.....D...S..M.T.R | .................. | ...... | ........... | A..A...A.R | 0.10 | 7 |
| G.... | ...........K..... | .................. | ...D.R | ..TGAS.A..DH | A..A........ | 0.09 | 6 |
| GT... | ................. | .................. | ...DDR | ...GT..AA.GD | A..A........ | 0.09 | 6 |
| ..... | F................ | .V................ | ...... | E.AAGND.EFDQ | A..A........ | 0.09 | 6 |
| ..... | ................. | .................. | ...NDR | ..AKG...AV.. | A..A........ | 0.09 | 6 |
| E.... | F................ | .Q.S......F....... | R..DD. | ........... | ........... | 0.07 | 5 |
| ..... | F................ | .V........F....... | ...... | ........... | ........... | 0.07 | 5 |
| ..... | ................. | .................. | ...DG. | ........... | A..A........ | 0.07 | 5 |
| ....T | F................ | .V........F....... | ...... | ........... | A..A........ | 0.07 | 5 |
| HT... | F................ | .V........F....... | ...... | ........... | A..A........ | 0.07 | 5 |
| ..... | ................. | .................. | ...ADR | .....K..... | A..A........ | 0.06 | 4 |
| ..... | ................. | .KYT.....DF......T | E..ND. | E.AGRDD...DR | A..A........ | 0.06 | 4 |
| ..... | ................. | .................. | ...D.R | ..ARTADTE.DS | A..A........ | 0.06 | 4 |
| A.... | ................. | .................. | ...... | ........... | ........... | 0.06 | 4 |

TABLE 2-continued

AAV capsid proteins having increased specificity for and/or transduction of CD133+ GSC (pool of Round 2 selection). Amino acid numbers correspond to the amino acid sequence of VP1 (SEQ ID NO: 1). Sequences below correspond to SEQ ID NOs: 8 and 296.523 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| AA... | ................. | .V........F....... | ...... | ............ | A..A........ | 0.06 | 4 |
| E.... | ................. | ................. | R..DD. | ............ | ............ | 0.04 | 3 |
| E.... | F.....AEG.LK.M.H.L | ..DGE....DF....... | ...... | ............ | ............ | 0.04 | 3 |
| ..... | F................. | .V........F....... | ...... | ............ | A..A........ | 0.04 | 3 |
| TA..T | ................. | ........DF....... | ....D. | ESGS.S.IA.DQ | A..A........ | 0.04 | 3 |
| ..... | F................. | .V........F....... | ...... | ............ | GARAT..SQ... | 0.04 | 3 |
| A.... | F.....AEG.LK.M.H.L | ..DGE....DF....... | ...... | ............ | ............ | 0.04 | 3 |
| ..... | ................. | ..HG......F....... | ...... | ............ | GTRGG...K..D | 0.04 | 3 |
| SA... | ................. | ................. | ...D. | ............ | ............ | 0.03 | 2 |
| ..... | F................. | .V........F....... | ...... | .NAAAN..EF.H | A..A........ | 0.03 | 2 |
| ..... | F................. | .V........F....... | ...... | ............ | THRDA...EG.E | 0.03 | 2 |
| ..... | ................. | ................. | ....G. | E.AAGSD.EVDR | A..A........ | 0.03 | 2 |
| .A... | F.....DAA.IK.T.Q.N | ..DGE....DF....... | ...D.. | ............ | ............ | 0.03 | 2 |
| ET..T | F.....AT...N.T...G | .QPNQ....NF..P...T | .....R | ............ | A..A........ | 0.03 | 2 |
| TA..T | F.....GDG....K.Q.R | .V........F....... | ...DDR | .SAKAA.AA.DE | A..A........ | 0.03 | 2 |
| ..... | ................. | ................. | R..... | ............ | A..A........ | 0.03 | 2 |
| D.... | ..........A...T.N | T.P......DF....... | ...D.. | ............ | ............ | 0.03 | 2 |
| ..... | ................. | ................. | ...D.. | E.TR.N.....Q | A..A........ | 0.03 | 2 |
| ..... | ................. | ..YN......F......T | ...D.R | ............ | A..A........ | 0.03 | 2 |
| R...T | ................. | ................. | ...DDR | .NAAAN..EF.H | A..A........ | 0.03 | 2 |
| ..... | ................. | ......S.......... | ...DDR | ............ | A..A........ | 0.03 | 2 |
| ..... | C................. | ................. | ...... | E.AG.S...... | A..A........ | 0.03 | 2 |
| ..... | F................. | .V........F....... | ...... | .......A.... | DQRGT...RG.D | 0.03 | 2 |
| ..... | ................. | ................. | E..NG. | ............ | ............ | 0.03 | 2 |
| TT..T | ................. | ................. | .....R | ............ | ............ | 0.03 | 2 |
| GT... | F.....AEG.LK.M.HRL | ..DGE....DF....... | ...... | ............ | ............ | 0.03 | 2 |
| ..... | ................. | ................. | E..AG. | ............ | ............ | 0.03 | 2 |
| ..... | ..N.............. | ................. | ...... | ............ | A..A........ | 0.03 | 2 |
| GT... | F.....A.A.RE.I.... | TKAT.....NF......T | R..AG. | ESAG....A.GE | A..A........ | 0.03 | 2 |
| ..... | ................. | .KYT.....DF....... | G..KGR | .DAS.N...VDG | A..A........ | 0.03 | 2 |
| GT..T | F......GA..K.M...E | ................. | ...... | ..AG.N..AF.R | A..A........ | 0.03 | 2 |
| ..... | ...............H. | ................. | ...D.. | .STGAD...... | A..A........ | 0.03 | 2 |
| GT... | ................. | ................. | ...D.. | .STGAD...... | A..A........ | 0.03 | 2 |
| TA... | ................. | .QD.E.....F..P.... | ...D.. | ............ | ....P....... | 0.03 | 2 |
| ..... | ................. | ................. | R..D.. | ESAAGD.IE.GD | A..A........ | 0.03 | 2 |
| ..... | ................. | ................. | ...D.R | ............ | A..A........ | 0.03 | 2 |
| NT... | ................. | ................. | ...... | EDANG...EV.N | A..A........ | 0.01 | 1 |

TABLE 2-continued

AAV capsid proteins having increased specificity for and/or transduction of CD133+ GSC (pool of Round 2 selection). Amino acid numbers correspond to the amino acid sequence of VP1 (SEQ ID NO: 1). Sequences below correspond to SEQ ID NOs: 8 and 296.523 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ......D........... | ...DDR | ........... | A..A........ | 0.01 | 1 |
| ..... | ................. | ......S........... | R..... | ........... | A..A........ | 0.01 | 1 |
| ..... | F.....AEG.LK.M.H.L | .QPG.....DF....... | ...DDR | ........... | ........... | 0.01 | 1 |
| ..... | F.....AEG.LK.M.H.L | ................. | ...DDR | ........... | A..A........ | 0.01 | 1 |
| ..... | ................. | ................. | R....E | ........... | A..A........ | 0.01 | 1 |
| ..... | F................ | .V........F....... | .....S | ........... | GARGG..FNM.Q | 0.01 | 1 |
| ..... | ................. | .PDNR..T.DF......T | ....GR | ........... | A..A........ | 0.01 | 1 |
| GT... | ................. | ................. | ....GR | EDAGT..AA..H | A..A........ | 0.01 | 1 |
| ..... | ................. | ................. | R...GR | EDTG.A....GN | A..A........ | 0.01 | 1 |
| ..... | F................ | .V........F....... | ....D. | ........... | GPKNP..DRT.D | 0.01 | 1 |
| E.... | ................. | T.HTE...NF......T | ...NDR | ........... | A..A........ | 0.01 | 1 |
| ..... | F................ | .QAS......F....... | R..ND. | ....E....... | A..A........ | 0.01 | 1 |
| TT... | F.....ASA.S..T.T.G | ................. | ...DDR | ........... | A..A........ | 0.01 | 1 |
| ..... | F................ | ..HG....NF......T | ...A.. | ........... | A..A........ | 0.01 | 1 |
| ..... | ................. | .V........F....... | ..G... | ........... | TARSA..VDG.A | 0.01 | 1 |
| RT... | ................. | ................. | G..A.R | ........... | A..T........ | 0.01 | 1 |
| ..... | F.....DRG.S..T.A.S | ..DGE....DF....... | ...... | ........... | ........... | 0.01 | 1 |
| ..... | F.....ASA.S..T.T.G | .Q.S.....F........ | ....D. | ........... | ........... | 0.01 | 1 |
| SA... | F.....ASA.S..T.T.G | .QPG.....DF....... | ...DDR | ........... | ........... | 0.01 | 1 |
| ..... | ................. | .Q.S............. | ...... | ........... | ........... | 0.01 | 1 |
| ..... | ................. | .V........F....... | ...... | ........... | A..A........ | 0.01 | 1 |
| ....P | ...........M..... | ................. | ...NDR | ..AKG...AV.. | A..A........ | 0.01 | 1 |
| DT... | F.....AEG.LK.M.H.L | ..DGE....DF....... | ...... | ........... | ........... | 0.01 | 1 |
| ..... | ................. | .QAS......F....... | ...... | E.TNAA.I.FDR | A..A........ | 0.01 | 1 |
| GT... | F.....AEG.LM.M.H.L | ..DGE....DF....... | ...... | ........... | ........... | 0.01 | 1 |
| ..... | ................. | ................. | G..N.E | ........... | ........... | 0.01 | 1 |
| ..... | ................. | ................. | ...DDR | E.A........ | A..A........ | 0.01 | 1 |
| G.... | ................. | .Q.GQ....DF....... | ....G. | EDAGRN...V.N | A..A........ | 0.01 | 1 |
| ..... | ................. | ................. | R..... | ....E....... | A..A........ | 0.01 | 1 |
| GA... | F.....ASA.S..T.T.G | ................. | ...DDR | ........... | A..A........ | 0.01 | 1 |
| ..... | ................. | ...........R... | ...D.. | ........... | ........... | 0.01 | 1 |
| ..... | F................ | .V....D...F....... | ...... | ........... | SQRAS..SDK.D | 0.01 | 1 |
| ..... | F................ | ................. | R..... | ........... | A..A........ | 0.01 | 1 |
| ..... | ................. | R................ | E..N.. | E.ATAS.AAFDE | A..A........ | 0.01 | 1 |

TABLE 3

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | .................. | .................. | ....GR | ..AG.N.AA.GQ | A..A........ | 1.91 | 216 |
| E.... | F.....ASA.S..T.T.G | .QPG.....DF....... | ...DDR | ............ | A..A........ | 1.15 | 130 |
| ..... | .................. | .................. | R...D. | E.AG..D.A.GR | A..A........ | 0.96 | 109 |
| GA... | F.....GNG.HV.H.G.R | TQ.TG....DF....... | ...DDR | ............ | A..A........ | 0.94 | 106 |
| .A... | F.....DRG.S..T.A.S | ..DGE....DF....... | ...... | ............ | ............ | 0.88 | 100 |
| GT... | F.....AEG.LK.M.H.L | ..DGE....DF....... | ...... | ............ | ............ | 0.85 | 96 |
| ..... | .................. | .................. | ...DDR | ............ | A..A........ | 0.80 | 90 |
| ..... | .................. | .................. | R..DD. | ............ | ............ | 0.80 | 90 |
| ..... | .................. | .................. | G..DG. | ............ | ............ | 0.80 | 90 |
| ..... | .................. | .................. | ...... | ............ | ............ | 0.79 | 89 |
| D...T | F......GT.NM.L.Q.G | .Q.S.....F........ | ....D. | ..AKG...AV.. | A..A........ | 0.74 | 84 |
| ..... | .................. | .................. | ...... | ............ | ............ | 0.72 | 82 |
| ..... | .................. | .................. | ...NDR | ............ | A..A........ | 0.65 | 74 |
| TA... | .................. | .QANH....DF....... | ...DDR | ............ | A..A........ | 0.55 | 62 |
| D.... | F.....AN...N.L.H.R | ..D......NF....... | R...D. | .SGAG.D..Y.E | A..A........ | 0.51 | 58 |
| ..... | .................. | .................. | R..DD. | ............ | A..A........ | 0.47 | 53 |
| ..... | F................. | .V........F....... | ...... | ............ | ............ | 0.43 | 49 |
| ..... | F................. | .V........F....... | ...... | ............ | S.KAG...EG.Q | 0.42 | 48 |
| GT... | .................. | ..HG.....NF......T | E..DD. | ............ | ............ | 0.42 | 47 |
| ..... | F.....ASA.S..T.T.G | .QPG.....DF....... | ...DDR | ............ | ............ | 0.38 | 43 |
| A.... | F.....DA..IA.L.K.R | .KDSR....DF......T | R..DD. | ............ | A..A........ | 0.34 | 38 |
| ..... | ..............P.A.K | .QPG.....NF....... | ...DDR | E.GGEN..EF.S | A..A........ | 0.31 | 35 |
| ..... | F.....AEG.LK.M.H.L | ..DGE....DF....... | ...... | ............ | ............ | 0.30 | 34 |
| TA... | F.....DRA.IN.M.K.L | .Q.S......F....... | ...DDR | ............ | A..A........ | 0.28 | 32 |
| ..... | .................. | .................. | E..KD. | ............ | ............ | 0.28 | 32 |
| ..... | .................. | .................. | ...D.R | ............ | ............ | 0.27 | 30 |
| ..... | .................. | .................. | E..AG. | ............ | ............ | 0.26 | 29 |
| ..... | .................. | .PPNG.....F......T | ...DDR | ............ | ............ | 0.26 | 29 |
| GA... | .................. | ..DGE....DF....... | E..TG. | E.ATRA..A.DE | A..A........ | 0.25 | 28 |
| ..... | .................. | .................. | R...D. | ............ | A..A........ | 0.25 | 28 |
| ..... | .................. | .................. | ...AG. | ............ | A..A........ | 0.25 | 28 |
| RA... | .................. | .................. | E..N.. | ............ | A..A........ | 0.25 | 28 |
| ..... | .................. | .................. | ...DDR | ............ | A..A........ | 0.24 | 27 |
| TT..T | .................. | ..........F......T | ...DG. | ............ | A..A........ | 0.23 | 26 |
| ..... | F.......T.SV...H.R | ..A......DF....... | E..ND. | E.TN.GD..Y.S | A..A........ | 0.23 | 26 |
| ..... | .................. | .................. | E..NG. | ............ | ............ | 0.22 | 25 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | .................. | E..ND. | .......... | ............ | 0.21 | 24 |
| ..... | .................. | .................. | ...DDR | .......... | A..A........ | 0.21 | 24 |
| ..... | .................. | .................. | E..AD. | .......... | ............ | 0.20 | 23 |
| ..... | .................. | .................. | E..AD. | .......... | ............ | 0.20 | 23 |
| ..... | .................. | .................. | ...D.. | .......... | A..A........ | 0.19 | 22 |
| ..... | .................. | .................. | R...D. | .......... | A..A........ | 0.19 | 22 |
| ..... | .................. | .................. | ...D.. | ESATGD..E.GQ | A..A........ | 0.19 | 21 |
| ..... | .................. | .................T | ...D.R | .......... | A..A........ | 0.19 | 21 |
| G.... | F.....GS..NK.M.A.R | ..YN......F......T | ...... | .......... | A..A........ | 0.19 | 21 |
| GA... | F.....AKG.NM.L...K | ..DGE....DF....... | ...... | .......... | A..A........ | 0.18 | 20 |
| ..... | F................. | .V........F....... | E..AD. | .......... | TQRDA...SSG.T | 0.18 | 20 |
| GA... | .................. | ...GG....NF....... | ...AG. | .......... | A..A........ | 0.18 | 20 |
| ..... | .................. | .................. | R...D. | .......... | A..A........ | 0.18 | 20 |
| ..... | .................. | ..P.G....NF....... | ...ADR | ...NG....VDG | A..A........ | 0.17 | 19 |
| ..... | .................. | .................. | ...... | .......... | A..A........ | 0.17 | 19 |
| EA... | F.....DAA.IK.T.Q.N | ..DGE....DF....... | R..AGR | E.......... | A..A........ | 0.17 | 19 |
| ..... | .................. | ..PNG....DF....... | ...D.. | .......... | A..A........ | 0.17 | 19 |
| ..... | .................. | .................. | ...D.. | .......... | A..A........ | 0.16 | 18 |
| ..... | .................. | .....QD.E.F..P.... | ...DDR | E.GGRGD.E..E | A..A........ | 0.16 | 18 |
| A.... | F.....NGG.NV.K.K.K | TKDDR....DF....... | ...... | E.AG...TAVGN | A..A........ | 0.16 | 18 |
| ..... | .................. | .................. | ...N.. | .......... | A..A........ | 0.16 | 18 |
| ..... | .................. | .................. | ...DDR | .......... | A..A........ | 0.16 | 18 |
| E.... | F.....SGA..N...G.R | .QPG.....NF....... | ...... | .......... | A..A........ | 0.16 | 18 |
| ..... | F................. | .V.......DF....... | ...... | .......... | A..A........ | 0.16 | 18 |
| H.... | .................. | ..DGE....DF....... | R...D. | .......... | ............ | 0.15 | 17 |
| ..... | F................. | .V.......F....... | ...... | .......... | ARQSG..AGS.. | 0.15 | 17 |
| AT... | .................. | .................. | G..KGR | .......... | A..A........ | 0.15 | 17 |
| RA... | F.....DTG.SK.T.T.R | .Q.S......F....... | ...D.. | .NGR.G..A..E | A..A........ | 0.15 | 17 |
| ..... | F................. | .................F. | ...... | .......... | ............ | 0.15 | 17 |
| ..... | ......DRG.S..T.A.S | ..DGE....DF....... | ...... | .......... | ............ | 0.15 | 17 |
| ..... | .................. | .................. | R...D. | .......... | A..A........ | 0.15 | 17 |
| ..... | .................. | .................. | ...DDR | ..AA.D.IA... | A..A........ | 0.14 | 16 |
| NA... | .................. | ..HDR....NF....... | ....D. | E.AGRN.TA..S | A..A........ | 0.14 | 16 |
| AA... | F.....SG..IK.K.D.R | ..P.E....NF......T | E..DG. | E.GAR..AA..Q | A..A........ | 0.14 | 16 |
| NA... | F.....N.T.LN.P...G | TKDDR....DF....... | ...DDR | E..SG...A.DG | A..A........ | 0.14 | 16 |
| ..... | .................. | .................. | ...D.. | .NAG.AD.AV.Q | A..A........ | 0.14 | 16 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | ..................... | ..ND.. | ENGD....E.DR | A..A........ | 0.13 | 15 |
| ..... | .................. | ..................... | ..N... | ...G.N.A.... | A..A........ | 0.13 | 15 |
| ..... | .................. | ..................... | R..ND. | E.ARGADI..GD | A..A........ | 0.13 | 15 |
| ..... | .................. | ..................... | R..N.. | ............ | A..A........ | 0.13 | 15 |
| ..... | F................. | .V........F........ | ...... | ............ | GHRAT..ND... | 0.13 | 15 |
| ..... | F......TG.KA.I.G.K | .........NF....... | E..N.. | ............ | A..A........ | 0.13 | 15 |
| ..... | .................. | .QPG.....DF....... | ...DDR | ............ | ............ | 0.13 | 15 |
| ..... | .................. | ..................... | E..DGR | .SAKAA.AA.DE | ............ | 0.12 | 14 |
| EA... | .................. | T..NE...DF......T | R..DD. | ............ | ............ | 0.12 | 14 |
| ..... | F.....SAT.PV.T.Q.G | ...TE.....F......T | ...D.. | ............ | A..A........ | 0.12 | 14 |
| A.... | F.....AAG.S..P...R | T.P......DF....... | R..DD. | EDGTRAD.AFGD | A..A........ | 0.12 | 14 |
| GT... | .................. | ..HG.....NF......T | E..DD. | EDGGGS..EYGS | ............ | 0.12 | 14 |
| ..... | F................. | .V........F......T | ...DDR | ............ | A..A........ | 0.12 | 14 |
| ..... | .................. | .Q.GQ....DF....... | R..ND. | ..AK.ADT..GN | A..A........ | 0.12 | 14 |
| ..... | .................. | ..................... | ...A.. | ............ | A..A........ | 0.12 | 14 |
| ..... | F.....NQA.SV...A.R | TQ.TQ.....F....... | ...DDR | ..A.A..AAFGE | A..A........ | 0.12 | 14 |
| GA... | F.....ASA.S..T.T.G | .QPG.....DF....... | ...DDR | ............ | ............ | 0.12 | 14 |
| RA... | F.....DGA.R..P.A.K | .........NF....... | R...D. | ............ | A..A........ | 0.11 | 13 |
| ..... | .................. | .I........F....... | ...N.. | ...G.S..AFGD | A..A........ | 0.11 | 13 |
| H.... | F.....NGA.H..N.E.L | .QPN......F......T | ...N.. | ............ | A..A........ | 0.11 | 13 |
| AA... | F.....GKA.HA...T.M | TKAT.....NF......T | ...D.. | ............ | A..A........ | 0.11 | 13 |
| ..... | .................. | ..................... | R..N.. | ..TG.A.I..D. | A..A........ | 0.11 | 13 |
| TA... | F.....SGG.SH...A.R | .Q.......DF....... | ...... | ES.GAN..EVDG | A..A........ | 0.11 | 13 |
| E.... | F.....ASA.S..T.T.G | .QPG.....DF....... | ...DDR | ............ | A..A........ | 0.11 | 13 |
| GT... | .................. | ..................... | R..DD. | ............ | ............ | 0.11 | 13 |
| ..... | .................. | ..................... | ...DDR | ..AG.DDIA.DN | A..A........ | 0.11 | 13 |
| A.... | F.....GRG.H..P.E.R | .QPN......F......T | ...N.. | E.AGAA..E.DR | A..A........ | 0.11 | 13 |
| RA... | .................. | .KPSE....DF......T | R...DR | .SAGRGDAAVDE | A..A........ | 0.11 | 13 |
| ..... | .................. | ..................... | E..NG. | ............ | A..A........ | 0.11 | 13 |
| HT..T | F.....NGG.NV.N.K.G | .........NF....... | R...D. | ............ | A..A........ | 0.11 | 13 |
| ..... | F................. | .V........F........ | ...... | ............ | A.RDP..FEV.. | 0.11 | 13 |
| ..... | .................. | ..................... | ...... | .DAGGND.A.D. | A..A........ | 0.11 | 13 |
| ..... | .................. | ..................... | ...... | ..AKG.D.AYDG | A..A........ | 0.11 | 13 |
| T.... | F.....ATA..V.H...R | .QAS.....F........ | ...... | .SGDE.D.E.DR | A..A........ | 0.11 | 13 |
| G.... | .................. | ..DGE...DF........ | ...... | .SGARD.A..DG | A..A........ | 0.11 | 12 |
| ..... | .................. | ..................... | ....D. | ............ | ............ | 0.11 | 12 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................ | ..DGE....DF....... | R...D. | ........... | ........... | 0.11 | 12 |
| TA... | F.........LA...H.G | .V........F....... | ...... | ........... | ........... | 0.11 | 12 |
| E.... | F.....AEG.LK.M.H.L | ..DGE....DF....... | ...... | ........... | ........... | 0.11 | 12 |
| SA... | ................ | .QAS......F....... | ...... | E.TNAA.I.FDR | A..A........ | 0.11 | 12 |
| H.... | F.....GN..NA.T...M | .Q.S......F....... | E..N.. | ..A.TS.AA.D. | A..A........ | 0.11 | 12 |
| AA... | F......S..SE.T...R | .........NF....... | R...D. | E.GT.ND.A.DG | A..A........ | 0.11 | 12 |
| NA... | ................ | .Q.DR.....F....... | ....D. | ENAS.G.A.VDS | A..A........ | 0.11 | 12 |
| ..... | ................ | ................ | R..ADR | ........... | A..A........ | 0.11 | 12 |
| ..... | ................ | ................ | ...DDR | E.GSR..AAVGD | A..A........ | 0.11 | 12 |
| ..... | ................ | ................ | E..KG. | ........... | ........... | 0.11 | 12 |
| ..... | ................ | ................ | ....D. | ........... | ........... | 0.11 | 12 |
| ....T | F.....SA..RA.....R | TKDDR....DF....... | ...DDR | ........... | A..A........ | 0.10 | 11 |
| ..... | ................ | ................T | ...... | .SA....AA.GH | A..A........ | 0.10 | 11 |
| ..... | F.....DGA.R..P.A.K | .QPTG....NF....... | E..AGR | ESA....GA.GE | A..A........ | 0.10 | 11 |
| ..... | F.....DRG.S..T.A.S | ..DGE....DF....... | ...... | ........... | ........... | 0.10 | 11 |
| TT..T | ................ | ..DGE....DF....... | R...D. | ........... | ........... | 0.10 | 11 |
| ..... | F......GT.NM.L.Q.G | .Q.S......F....... | ....D. | ........... | ........... | 0.10 | 11 |
| ..... | ................ | TKHGG....NF......T | R...D. | E.TDGNDA...N | A..A........ | 0.10 | 11 |
| ..... | ................ | ................ | ...DGR | EDAG...I..GQ | A..A........ | 0.10 | 11 |
| S.... | ..........L..L.Q.G | .QPSQ....NF....... | E..NGR | ........... | A..A........ | 0.10 | 11 |
| ..... | ................ | ................ | R..ND. | ........... | A..A........ | 0.10 | 11 |
| G.... | F.....ASG.SI.T...R | TKDDR....DF....... | ...DDR | ..GGGADAA.GE | A..A........ | 0.10 | 11 |
| E.... | ................ | ................ | R..TGR | ESGGANDI...R | A..A........ | 0.10 | 11 |
| ..... | ................ | ................ | ...DDR | ...G..DAE.DS | A..A........ | 0.10 | 11 |
| RT... | F.....SA..RA.....R | .........NF....... | R...D. | E.TGGNDAE.DD | A..A........ | 0.10 | 11 |
| ..... | ................ | ................ | G..KD. | ........... | A..A........ | 0.10 | 11 |
| ..... | ................ | ..HGH....NF......T | ...D.. | ........... | A..A........ | 0.09 | 10 |
| ..... | ................ | ................ | ...DD. | ........... | A..A........ | 0.09 | 10 |
| SA..T | ................ | .QPTR.....F....... | G...GR | ..ASE...E.D. | A..A........ | 0.09 | 10 |
| ..... | ................ | ................ | R..TG. | ........... | A..A........ | 0.09 | 10 |
| AT..T | F.....GHA.SK.T.E.K | ..DGE....NF......T | ...... | ENASG.....GN | A..A........ | 0.09 | 10 |
| RA... | F.....AAT.N..P.P.R | .PPNG.....F......T | ...DDR | ..A.G...AYD. | A..A........ | 0.09 | 10 |
| AA... | F.....GRG.SP.K...G | .QPG.....NF....... | ...DDR | ........... | A..A........ | 0.09 | 10 |
| ..... | ................ | ................ | R...D. | ...AAS.A.VGQ | A..A........ | 0.09 | 10 |
| ..... | ................ | ................ | G..DDR | ........... | A..A........ | 0.09 | 10 |
| A.... | F............... | TQ.TG....DF....... | ...DDR | ..AGT.D.EYGQ | A..A........ | 0.09 | 10 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ......STA..Q.H.Q.L | T.P......DF....... | R...D. | ............ | A..A........ | 0.09 | 10 |
| ..... | F................. | .........DF....G.T | ....GR | ENAGGD..E..R | A..A........ | 0.09 | 10 |
| ..... | F.....DRG.S..T.A.S | .V........F....... | ...... | ............ | A..A........ | 0.09 | 10 |
| ....T | F.....AQG.LH.L.G.R | .KPDQ.....F....... | ...... | EN.SAGD..... | A..A........ | 0.09 | 10 |
| GT... | F.....AEG.LK.M.H.L | ..HG.....NF......T | E..DD. | ............ | ............ | 0.09 | 10 |
| ..... | F................. | .V........F....... | ...... | ............ | NPRAP...TN.E | 0.09 | 10 |
| ..... | F................. | .V........F....... | ...... | ............ | GARAT..DTE.H | 0.09 | 10 |
| TT..T | F................. | .V........F......T | ...DDR | ............ | A..A........ | 0.09 | 10 |
| ..... | F................. | .V........F....... | ...... | ............ | GRHGG..SEG.E | 0.09 | 10 |
| ..... | .................. | .................. | ...... | ENTTGN....DR | A..A........ | 0.09 | 10 |
| ..... | F................. | .V........F....... | ...... | ............ | GT.TR..FQM.E | 0.09 | 10 |
| ..... | .................. | .................. | ....GR | ..AGA..AA.GS | A..A........ | 0.09 | 10 |
| G.... | F.....NGG.HV.....L | .QP.G.....F....... | G..KD. | .NATGND.E..H | A..A........ | 0.09 | 10 |
| ..... | F................. | .V........F....... | ...... | ............ | G.RTG..VR..H | 0.09 | 10 |
| GT... | F.....NAT.RD.M.T.K | ..YN......F......T | ...D.R | ............ | A..A........ | 0.08 | 9 |
| NA... | F.....SA..RA.....R | ..DGE....DF....... | ...... | .NGG.ND....Q | A..A........ | 0.08 | 9 |
| GA... | F.....AA..IQ.T.K.R | .Q.DH....NF....... | ...DD. | E.GAGAD...GQ | A..A........ | 0.08 | 9 |
| ..... | .................. | .................. | G..ANR | ...........N | A..A........ | 0.08 | 9 |
| ET..T | F.....NT..SH.M.D.. | .........NF....... | R...D. | ............ | A..A........ | 0.08 | 9 |
| TA... | .................. | ..HG.....NF......T | ...DDR | ............ | A..A........ | 0.08 | 9 |
| ..... | .................. | .........F......T | ...DGR | ..ADAGD.AV.Q | A..A........ | 0.08 | 9 |
| ..... | .................. | ....G....DF....... | E..AD. | ...SGSD..FDN | A..A........ | 0.08 | 9 |
| R.... | F.....DT..LK.T.H.G | .................. | R..DG. | ............ | A..A........ | 0.08 | 9 |
| D...T | F.....AET..A.T...K | .V........F....... | R...D. | ENTGAGDA.VDR | ............ | 0.08 | 9 |
| GT... | .................. | .................. | E..KD. | ............ | ............ | 0.08 | 9 |
| ..... | F................. | .V........F....... | ...... | ............ | TPRSP..FDS.T | 0.08 | 9 |
| ..... | .................. | .................. | ...DDR | ...GT..AA.GD | A..A........ | 0.08 | 9 |
| ..... | .................. | .................. | R..N.. | .DTSANDT..DG | A..A........ | 0.08 | 9 |
| ..... | .................. | .................. | ...DDR | .NGSAS..A.DN | A..A........ | 0.08 | 9 |
| ..... | .................. | .................. | E..KD. | ............ | A..A........ | 0.08 | 9 |
| AA... | F.....SN..PL.K.T.. | ..HG.....NF......T | ...A.. | ............ | A..A........ | 0.08 | 9 |
| ..... | F................. | .V........F....... | ...... | ............ | NARTA...KE.Q | 0.08 | 9 |
| E...T | F.....DTG.SK.T.T.R | .QPTG.....F....... | ...NDR | ............ | A..A........ | 0.08 | 9 |
| ..... | F.....AGG.SI.T.G.M | ..DGE....DF....... | ...... | .DTSANDT..DG | A..A........ | 0.08 | 9 |
| ..... | F................. | .V........F....... | ...... | ............ | SHRDG..SDN.E | 0.08 | 9 |
| RA... | F.....SRA.SK.N.A.H | .QDT.....DF....... | ...DDR | ...G.S..AFGD | A..A........ | 0.08 | 9 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | ................. | .V........F....... | ...... | ........... | A..A........ | 0.08 | 9 |
| ..... | ................. | .PPNG.....F......T | ...DDR | ..AGA..AA.GS | A..A........ | 0.08 | 9 |
| GT... | F.....DHT.R..M.G.R | .PPNG.....F......T | ....D. | ........... | A..A........ | 0.08 | 9 |
| H.... | F.....NKG.S..H.N.G | .QPNE.....F..P...T | R...D. | ........... | A..A........ | 0.08 | 9 |
| ..... | F................ | ................. | ...... | ........... | A..A........ | 0.08 | 9 |
| GT... | ................. | ................. | ...N. | ...G.N.A.... | A..A........ | 0.08 | 9 |
| E.... | F.....AAG.RV.L.K.R | TKDDR....DF....... | ...DDR | ..AGT.D.EYGQ | A..A........ | 0.08 | 9 |
| ..... | F................ | .V........F....... | ...... | ........... | TPRGP..VTG.H | 0.08 | 9 |
| ..... | ................. | ................. | G...D. | ........... | A..A........ | 0.08 | 9 |
| SA... | F......N..NH.L.P.S | ................. | ....GR | ........... | A..A........ | 0.08 | 9 |
| ..... | F................ | ........DF....... | ...DDR | ........... | A..A........ | 0.08 | 9 |
| ..... | ................. | ................. | ...ND. | ........... | A..A........ | 0.08 | 9 |
| ..... | F.......T.SV...H.R | .Q.G......F......T | ...D.. | ........... | A..A........ | 0.08 | 9 |
| SA..T | ................. | .K.TG....DF....... | R...DR | ..ATRS.I..GN | A..A........ | 0.08 | 9 |
| ..... | ................. | T.P......DF....... | ...D.. | .NTSTSD.E.DG | A..A........ | 0.08 | 9 |
| E.... | F.....ST..SV.K.H.M | ................. | ...... | ED.GR..I..DN | A..A........ | 0.08 | 9 |
| R.... | F.....SG..IK.K.D.R | T.PTG....DF....... | ...DDR | ES.DGN..A.DG | A..A........ | 0.08 | 9 |
| G.... | F.....DTG.SK.T.T.R | .Q.GQ....DF....... | ....G. | .SG..ND...DG | A..A........ | 0.08 | 9 |
| ..... | F................ | .V........F....... | ...... | ........... | TQRSG..IT..E | 0.08 | 9 |
| ..... | ................. | ........NF....... | ...D.R | ENGKAGD...GN | A..A........ | 0.08 | 9 |
| SA... | ................. | ..DGE....DF....... | ...... | ENGD.S.TA.DR | A..A........ | 0.08 | 9 |
| D...T | ................. | ................. | ...DG. | EDAGT..AA..H | A..A........ | 0.08 | 9 |
| NT..T | F.....SG..IK.K.D.R | .PPNG.....F......T | ...DDR | ........... | A,.A........ | 0.08 | 9 |
| ..... | ................. | ................. | R..DD. | .NTGGG.....H | A..A........ | 0.08 | 9 |
| ..... | F................ | .V........F....... | ...... | ........... | GQRNP..SDV.H | 0.07 | R |
| ..... | F................ | .V........F....... | ...... | ........... | GTRDG..AE..A | 0.07 | 8 |
| TT..T | ................. | ...GG....NF....... | E..AD. | ........... | A..A........ | 0.07 | 8 |
| ..... | ................. | ................. | ...DG. | ........... | A..A........ | 0.07 | 8 |
| RA... | ................. | T.PTG....DF....... | ...DDR | .DAS.N...VGG | A..A........ | 0.07 | 8 |
| AT..T | F.....GS..NM.N.E.R | ..DGE....DF....... | ...... | ........... | A..A........ | 0.07 | 8 |
| ..... | ................. | .Q.......DF....... | ...AD. | .D.RGN.IAYDE | A..A........ | 0.07 | 8 |
| ..... | F................ | .V........F....... | ...... | ........... | TRSGG..FSR.D | 0.07 | 8 |
| ..... | ................. | ........DF......T | R..DG. | .NAG.S.IAFGN | A..A........ | 0.07 | 8 |
| ..... | ................. | ..........F....... | R..AD. | ........... | A..A........ | 0.07 | 8 |
| ..... | ................. | TKDT.....NF......T | G..A.R | ........... | A..A........ | 0.07 | 8 |
| ..... | F................ | .V........F....... | ...... | ........... | AR.NP..YRN.D | 0.07 | 8 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................ | .KYT.....NF......T | ...AD. | .......... | A..A........ | 0.07 | R |
| G.... | F.....SN..PL.K.T.. | .........NF....... | R...D. | .......... | A..A........ | 0.07 | 8 |
| RA... | F.....STA..Q.H.Q.L | .Q.S......F....... | ...TG. | .......... | A..A........ | 0.07 | 8 |
| DT... | F.....GRT..L.H.E.S | .QAS.....NF......T | R..DD. | .SAS.N.IA..E | A..A........ | 0.07 | 8 |
| ..... | ................ | ................ | R..TD. | .SAS.N.IA..E | A..A........ | 0.07 | 8 |
| ..... | ................ | ................ | ...DD. | ...R.G.....E | A..A........ | 0.07 | 8 |
| G.... | F.....SRG.HH.L.D.R | .V........F....... | ...... | .SAT.N.IA..H | A..A........ | 0.07 | 8 |
| AA..T | F.....ST..SV.K.H.M | ..YN......F......T | ...D.R | .......... | A..A........ | 0.07 | 8 |
| ..... | ................ | ................ | ...D.R | ESATGG.T..GG | A..A........ | 0.07 | 8 |
| ..... | ................ | .........NF.....P. | ...... | .......... | A..A........ | 0.07 | 8 |
| ..... | ................ | ..HG.....NF......T | E..DD. | ..AG.G..E.GE | A..A........ | 0.07 | 8 |
| ..... | F............... | .V........F....... | ...... | .......... | DPKNK...GT.H | 0.07 | 8 |
| .A... | F.....ASA.S..T.T.G | .QPG.....DF....... | ....D. | .......... | A..A........ | 0.07 | 8 |
| D...T | ................ | | G..DG. | .......... | ............ | 0.07 | 8 |
| ..... | F............... | .V........F....... | ...... | .......... | SRSDN..S.E.H | 0.07 | 8 |
| ..... | F............... | .V........F....... | ...... | .......... | TQRGA..IDT.D | 0.07 | 8 |
| ..... | ................ | .QPN......F......T | ...... | .......... | ............ | 0.07 | R |
| ..... | ................ | ................ | ...DDR | E.AG..D.A.GR | A..A........ | 0.07 | 8 |
| D...T | ................ | .QPN......F......T | ...N.. | .......... | A..A........ | 0.07 | 8 |
| TT... | F.....SN..PL.K.T.. | ................ | ...... | .......... | A..A........ | 0.07 | 8 |
| G.... | F.....NKT.HL.T.A.R | ................ | ...... | ..AA.N..AV.H | A..A........ | 0.07 | 8 |
| GA... | F.....NKG.S..H.K.G | ................ | ...... | .......... | A..A........ | 0.07 | 8 |
| ..... | ................ | ................ | ...A.. | EDTGAD....DS | A..A........ | 0.07 | 8 |
| A.... | ................ | ................ | ...DDR | ESGN.N.A..GS | A..A........ | 0.07 | 8 |
| .A... | F.....NQT.RN.T.D.R | TK.T.....DF......T | ...NDR | .......... | A..A........ | 0.07 | 8 |
| ....T | F.....DRG.S..T.A.S | ..DGE....DF....... | ...... | .......... | ............ | 0.07 | 8 |
| TT..T | F.....AAA.NI.L.K.N | ..A......DF....... | ...DG. | .DAG.A.I..DG | A..A........ | 0.07 | 8 |
| SA... | F.....GN..HI.P.Q.. | .........NF....... | ....D. | .SARG.D.AVDD | A..A........ | 0.07 | 8 |
| A.... | ................ | T.PTG....DF....... | ...DDR | E..G.SDAA.GD | A..A........ | 0.07 | 8 |
| DT... | F.....A.G.RM.L.T.E | TQ.TG....DF....... | ...DDR | .......... | A..A........ | 0.07 | 8 |
| EA... | F.....AQ...A.L.... | .QPN......F......T | ...NDR | ..AGRSDI..GN | A..A........ | 0.07 | 8 |
| ..... | F............... | .V........F....... | ...... | .......... | TTRGD....K.Q | 0.07 | 8 |
| ..... | F............... | .V........F....... | ...... | .......... | NTRSG..AK..H | 0.07 | 8 |
| ..... | F............... | .V........F....... | ...... | .......... | SARTT..SSM.A | 0.07 | 8 |
| G...T | F.....SNA.PK.N.A.S | ..DGE....DF....... | ...... | EDGGGG..A..Q | A..A........ | 0.07 | 8 |
| GT... | F............... | ..HG.....NF......T | E..DD. | .......... | ............ | 0.07 | 8 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | ................. | ................. | ...D.. | .STGAD...... | A..A........ | 0.07 | R |
| ..... | F................ | .V........F....... | ...... | ............ | SPRDG..VGA.K | 0.07 | 8 |
| ..... | ................. | ..DD.....DF....... | R...D. | ESAGRNDIA.DQ | A..A........ | 0.06 | 7 |
| ..... | ................. | ................. | ...N.. | E..TAA.AAFDE | A..A........ | 0.06 | 7 |
| .A... | ................. | ..DGE....DF....... | E..AD. | ............ | A..A........ | 0.06 | 7 |
| RA... | F.....D...S..M.T.R | .RPT......F..P...T | ...ND. | ..A.G...AYD. | A..A........ | 0.06 | 7 |
| DA..T | F.....NGG.HV.....L | .Q.DR.....F....... | ...DDR | ..ARGADAE..S | A..A........ | 0.06 | 7 |
| EA..T | F.....GN..NA.T...M | ................. | G..ND. | ............ | A..A........ | 0.06 | 7 |
| ST... | F.....NRT..A.N.G.S | .Q.SG....NF....... | R..DD. | E.ATA.DA.VDQ | A..A........ | 0.06 | 7 |
| E.... | F......RT.LA.L.G.K | ................. | ...... | ............ | A..A........ | 0.06 | 7 |
| AA... | ................. | .Q.DR.....F....... | ....D. | E.GTAN..AVD. | A..A........ | 0.06 | 7 |
| ..... | ................. | ................. | ...... | E.TGT.DAAVDD | A..A........ | 0.06 | 7 |
| EA..T | F.....GSA.RV.L.A.R | ..HG.....NF......T | ...A.. | ............ | A..A........ | 0.06 | 7 |
| ..... | ................. | .V........F....... | ...... | ............ | | 0.06 | 7 |
| ..... | ................. | ................. | ...D.. | EDTSGAD...DE | A..A........ | 0.06 | 7 |
| ..... | ................. | ................. | R...D. | .NGSAS..A.DN | A..A........ | 0.06 | 7 |
| TA... | F.....SRA.SK.N.A.H | .QDT.....DF....... | ...DDR | ...G.S..AFGD | A..A........ | 0.06 | 7 |
| ..... | ................. | ................. | ...... | E.AGTNDI...R | A..A........ | 0.06 | 7 |
| AA... | F.....NT.....K.A.R | TKDT.....NF....... | ...DDR | ENG.ASD.E.GQ | A..A........ | 0.06 | 7 |
| ..... | ................. | ................. | E..N.. | E.TGT...AV.S | A..A........ | 0.06 | 7 |
| GT..T | ................. | .QHNQ.....F......T | ...DDR | ..GA.A...V.H | A..A........ | 0.06 | 7 |
| ..... | ................. | ................. | ...NGR | ............ | A..A........ | 0.06 | 7 |
| TA... | F......S..PM.T.S.K | .RPT.....DF....... | ...DD. | ..AGA..AA.GS | A..A........ | 0.06 | 7 |
| A.... | ................. | .KYT.....NF....... | ...D.. | ............ | | 0.06 | 7 |
| AT... | F.......G.N..T.P.L | ..DGE....DF....... | ...... | ...A.SD.EVGG | | 0.06 | 7 |
| AA... | F.....STG.HE.L...M | .QD......NF....... | E..AD. | ............ | A..A........ | 0.06 | 7 |
| AA... | ................. | .QHNQ.....F......T | ...N.. | ..AGG....DDQ | A..A........ | 0.06 | 7 |
| ..... | F................ | .V........F....... | ...... | ............ | G.RTA..SRV.E | 0.06 | 7 |
| ..... | ................. | ................. | E..TG. | .SA.TG.A..GQ | A..A........ | 0.06 | 7 |
| ..... | F................ | .V........F....... | ...... | ............ | ...DP..FTV.E | 0.06 | 7 |
| ..... | F.....SA..RA.....R | ..DD.....DF....... | R...D. | ESAG...TEYD. | A..A........ | 0.06 | 7 |
| ..... | F................ | .V........F....... | ...... | ............ | TARTP..DSA.E | 0.06 | 7 |
| ..... | ................. | ................. | ...D.. | E..TRS.AE.GS | A..A........ | 0.06 | 7 |
| ..... | F................ | .V........F....... | ...... | ............ | NTRSG..SSS.D | 0.06 | 7 |
| ..... | .........A.N....R | .KYT.....NF......T | R...D. | ...G.D..EVGQ | A..A........ | 0.06 | 7 |
| DA... | ................. | ................. | E..AGR | .NAG.NDT..DG | A..A........ | 0.06 | 7 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| SA..T | F.....NQG.RV.I.N.R | .........NF....... | R...D. | .DASGDD.EVD. | A..A........ | 0.06 | 7 |
| AA... | ................. | .KDSR....DF....... | E..ND. | ........... | A..A........ | 0.06 | 7 |
| EA... | F.....ASA.PN.P.A.R | .PPNG.....F......T | ...DDR | ...GRS.IEF.. | A..A........ | 0.06 | 7 |
| ..... | F.....SK..PA.K.A.G | ..DGE....DF....... | ...DD. | ........... | A..A........ | 0.06 | 7 |
| ..... | F......AG..L.T.N.R | T..NE....DF....... | ...DDR | ..AKGS.AAYDS | A..A........ | 0.06 | 7 |
| ..... | ................. | .........NF......T | E..N.. | E.TR.N.....Q | A..A........ | 0.06 | 7 |
| ..... | ................. | ................. | G..N.. | ........... | A..A........ | 0.06 | 7 |
| GT... | ................. | ..DGE....DF....... | ...... | ........... | ............ | 0.06 | 7 |
| ..... | F................ | .V........F....... | ...... | ........... | A.KTP..VQG.E | 0.06 | 7 |
| ..... | F................ | .V........F....... | ...... | ........... | SERGN..SKT.. | 0.06 | 7 |
| ..... | ................. | ................. | R...D. | E..GGG..EF.G | A..A........ | 0.06 | 7 |
| AA... | F.....GRT.S..L.G.R | .........F..P.... | R..... | .NAAEND...GE | A..A........ | 0.06 | 7 |
| GA... | F.....NGG.HN.K.G.E | ..A......DF....... | ...DG. | E.ATRA..A.DE | A..A........ | 0.06 | 7 |
| GA... | F.....GQ..LN.L.D.R | .Q.S......F....... | ...DDR | ........... | A..A........ | 0.06 | 7 |
| RA..T | F.....NDT.IP.T...K | .Q.DR.....F....... | ....D. | ........... | A..A........ | 0.06 | 7 |
| ..... | F................ | .V........F....... | ...... | ........... | GNRTT..FTG.A | 0.06 | 7 |
| ..... | ................. | ................. | G..NDR | ...G.S..AFGD | A..A........ | 0.06 | 7 |
| R.... | ................. | TKDDR....DF....... | ...DDR | ........... | A..A........ | 0.06 | 7 |
| GA... | F.....AG..PA.K.G.R | .Q.DR.....F....... | ....D. | ........... | A..A........ | 0.06 | 7 |
| ..... | F.....A.A.NH.I.Q.G | ..HG.....NF......T | ...A.. | ........... | A..A........ | 0.06 | 7 |
| ..... | F................ | .V........F....... | ...... | ........... | TRSAT..SNE.Q | 0.06 | 7 |
| ..... | ......SG..IK.K.D.R | .KPDQ....DF....... | ...D.. | .NATG....VGS | A..A........ | 0.06 | 7 |
| SA... | F................ | .V........F....... | ...... | ........... | A..A........ | 0.06 | 7 |
| ..... | ................. | ................. | ...... | ..GRRA..E.DQ | A..A........ | 0.06 | 7 |
| ..... | ................. | ..PN.....NF....... | ...N.. | E.GNGS....GR | A..A........ | 0.06 | 7 |
| D...T | F.....NKT.HL.T.A.R | ..DGE....DF....... | ...... | ........... | A..A........ | 0.06 | 7 |
| ..... | F......RG.H..L.E.G | .V........F....... | ...... | ........... | A..A........ | 0.06 | 7 |
| ..... | F................ | .V........F....... | ...... | ........... | EERNT..S.T.E | 0.06 | 7 |
| TT..T | ................. | .QPTG....NF....... | ...DDR | E.GNG.D.E.DS | A..A........ | 0.06 | 7 |
| ..... | ................. | .........DF....... | ...... | ..GG...I..GH | A..A........ | 0.05 | 6 |
| ..... | ......DAA.IK.T.Q.N | ..DGE....DF....... | ...... | E.......... | ............ | 0.05 | 6 |
| G.... | F.....SG..IK.K.D.R | ................T | ...... | ...DTN..E.DR | A..A........ | 0.05 | 6 |
| D...T | F.....AGG.P..L...G | ..PN.....NF....... | ...NDR | ........... | A..A........ | 0.05 | 6 |
| AA... | F.....STA..Q.H.Q.L | ..PDG....NF....... | ....DR | ........... | A..A........ | 0.05 | 6 |
| SA..T | ................. | ................. | ...... | ........... | ............ | 0.05 | 6 |
| SA... | F.....NGG.NN.K.T.R | .Q.DR.....F....... | ....D. | .DGGGS.....G | A..A........ | 0.05 | 6 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| DA... | F.....GET.IA.H.N.H | .QPG.....NF....... | ...DDR | E.AAGSD.E.GG | A..A........ | 0.05 | 6 |
| ..... | ................. | ................. | G..TG. | .D.TGN.I...Q | A..A........ | 0.05 | 6 |
| ..... | ................. | ........NF....... | ...DDR | ........... | A..A........ | 0.05 | 6 |
| ..... | ................. | ................. | R..NDR | E.AG..D.A.GR | A..A........ | 0.05 | 6 |
| S.... | F.......G.HK.T.N.G | .QHNQ.....F......T | ...... | ........... | A..A........ | 0.05 | 6 |
| GA... | F.....STA..Q.H.Q.L | T.P......DF....... | R...D. | ........... | ........... | 0.05 | 6 |
| E.... | ................. | .QANH.....F......T | R..D.. | .SAKAA.AA.DE | A..A........ | 0.05 | 6 |
| ..... | ................. | ................. | ...D.R | .NADRN..E.GE | A..A........ | 0.05 | 6 |
| ..... | ......N.......... | ................. | R..DG. | ........... | A..A........ | 0.05 | 6 |
| R.... | F.....GGG.PL.M.A.R | ................. | ...D.R | ........... | A..A.A..... | 0.05 | 6 |
| ..... | F.....SRA.SK.N.A.H | ..DGE....DF....... | ...DDR | .N.SGNDIE.DQ | A..A........ | 0.05 | 6 |
| TA... | ................. | TQ.GR.....F......T | ...DDR | ........... | A..A........ | 0.05 | 6 |
| ..... | ................. | ................. | ...DDR | .DAR...AEY.R | A..A........ | 0.05 | 6 |
| GA... | F.....ATT..N.L...L | .KYT.....NF......T | ...D.. | ........... | A..A........ | 0.05 | 6 |
| ..... | F................ | .V........F....... | ...... | ........... | KNKGP..AHE.H | 0.05 | 6 |
| D...T | ................. | ..PDG....NF....... | ....DR | E..G.SDAA.GD | A..A........ | 0.05 | 6 |
| G.... | F.....GR..SK.N.T.S | .Q.D.....DF....... | ...DDR | ........... | A..A........ | 0.05 | 6 |
| ..... | ................. | .QPN......F......T | ...N. | ........... | A..A........ | 0.05 | 6 |
| GT... | F.....AEG.LK.M.H.L | .QPG.....DF....... | ...... | ........... | GTRDG..AE..A | 0.05 | 6 |
| TT..T | F.....DA..IA.L.K.R | .KDSR....DF......T | R..DD. | ........... | A..A........ | 0.05 | 6 |
| ..... | ................. | ................. | ...... | E..TRSD.AFDD | A..A........ | 0.05 | 6 |
| ..... | F.....NKG.NI.N.E.R | .QPN......F......T | ...N.. | ........... | A..A........ | 0.05 | 6 |
| ..... | ................. | .........F....... | ...DDR | ES.SA..I..DR | A..A........ | 0.05 | 6 |
| ..... | ................. | ................. | ...... | ........... | ........... | 0.05 | 6 |
| ..... | ......AST.IN.L.T.. | ..DGE....DF....... | ...... | ........... | ........... | 0.05 | 6 |
| DT... | F.....ATG.NV.T.G.R | .Q.GQ....DF....... | ....G. | .DG.GA.IEFDR | A..A........ | 0.05 | 6 |
| ..... | ................. | ................. | G..TDR | E.AGGN..E.DD | ........... | 0.05 | 6 |
| ..... | ......GN..IK.L...G | .QAS......F....... | ...... | ........... | A..A........ | 0.05 | 6 |
| ..... | F................ | .V........F....... | ...... | ........... | KH.DR....G.A | 0.05 | 6 |
| A.... | F.....GE..LQ.N.T.R | .QD.E.....F..P.... | ...... | ........... | A..A........ | 0.05 | 6 |
| HA... | F.....GKG.ND.T.N.G | ..A......DF....... | ...DG. | ........... | ........... | 0.05 | 6 |
| TT..T | ................. | ................. | ...... | ........... | DHRNP..DQA.. | 0.05 | 6 |
| ..... | ................. | ................. | ....GR | ........... | A..A........ | 0.05 | 6 |
| ..... | ................. | ................. | ...... | ..TAGN..A..N | A..A........ | 0.05 | 6 |
| ..... | F................ | .V........F....... | ...... | ........... | .EKGG...QN.. | 0.05 | 6 |
| ..... | F................ | .V........F....... | ...... | ........... | GRSAD..DTS.H | 0.05 | 6 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| GA... | F.....SAG..L.H...K | ................. | ...... | ........... | A..A....... | 0.05 | 6 |
| ..... | ................. | .........DF......T | G..ND. | ........... | A..A....... | 0.05 | 6 |
| ..... | F................ | .V......F........ | ...... | ........... | GARGP..D.I.E | 0.05 | 6 |
| ..... | ................. | ................. | ...... | ENAGGD..E..R | A..A....... | 0.05 | 6 |
| ..... | ................. | ................. | E..DD. | ........... | A..A....... | 0.05 | 6 |
| TA..T | F.....NA..RM.M.K.. | ..DGE....DF...... | ...DDR | ........... | A..A....... | 0.05 | 6 |
| ..... | F................ | .V......F........ | ...... | ........... | DRRSH..S.G.D | 0.05 | 6 |
| ..... | ................. | .QAS......F...... | ...... | ........... | A..A.....A | 0.05 | 6 |
| TT..T | ................. | ..DGE....DF...... | R...D. | ........... | A..A....... | 0.05 | 6 |
| TT... | F.....AE...A.T...R | .QPN......F......T | ...A.. | ........... | A..A....... | 0.05 | 6 |
| ..... | ................. | ........R.F......T | ...DDR | E..AGS.TEFDQ | ........... | 0.05 | 6 |
| ..... | ................. | .QPD.....DF...... | ...DDR | ED.TTGDA...G | A..A....... | 0.05 | 6 |
| TA..T | F.....ARA.IE.....L | .Q.DR.....F...... | ....D. | .NGGGN..E.DG | A..A....... | 0.05 | 6 |
| TA..T | F.....NGG.IM.L.E.R | T.P......DF...... | ....D. | ........... | ........... | 0.05 | 6 |
| ..... | ................. | .Q.GQ....DF...... | R..TDR | .DAG.S.A..DR | A..A....... | 0.05 | 6 |
| ..... | ................. | ................. | ...DDR | ..ATGD..EV.Q | A..A....... | 0.05 | 6 |
| ..... | ................. | ................. | ...... | E.AAGSD..... | A..A....... | 0.05 | 6 |
| GT... | F.....SRA.SK.N.A.H | T.P......DF...... | ...DDR | ........... | A..A....... | 0.05 | 6 |
| T...T | F.....N.G.RE.H.A.R | .Q.DR.....F...... | ....D. | ........... | A..A....... | 0.05 | 6 |
| EA... | F................ | TK.NE...DF......T | ...DDR | ........... | A..A....... | 0.05 | 6 |
| ..... | F................ | .V........F...... | ...... | ........... | SDRGA..SQE.E | 0.05 | 6 |
| ..... | ................. | .KYT.....NF......T | ...... | ED.GGN.IE..R | A..A....... | 0.05 | 6 |
| E.... | F.....A.A.NH.I.Q.G | ..HG.....NF......T | ...DDR | E.TGAN.AE.GE | A..A....... | 0.05 | 6 |
| ..... | F................ | .V........F...... | ...... | ........... | DR.NK..DSG.Q | 0.05 | 6 |
| SA... | ................. | TQA.H....DF...... | ...... | ........... | A..A....... | 0.05 | 6 |
| R...T | F.....DKG.HM.L.G.R | .........DF...... | ...... | ........... | A..A....... | 0.05 | 6 |
| ..... | F.....DSA..A.I...R | ........NF...... | ...DDR | ........... | A..A....... | 0.05 | 6 |
| ..... | F................ | .V........F...... | ...... | ........... | THRT...VRN.D | 0.05 | 6 |
| ....T | ................. | ..AGQ....NF...... | ...DDR | ........... | A..A....... | 0.05 | 6 |
| RA... | F.....ATT..N.L...L | .QPN......F......T | ...N.. | E.ANG...E.G. | A..A....... | 0.05 | 6 |
| GT... | F................ | .V........F...... | ....G. | ........... | ........... | 0.05 | 6 |
| ..... | ................. | ................. | R...D. | EDAG...I..GQ | A..A....... | 0.05 | 6 |
| ..... | F................ | .V........F...... | ...... | ........... | DPKSR..FG..T | 0.05 | 6 |
| A...T | F................ | .V........F...... | ...... | ........... | A..A....... | 0.05 | 6 |
| ..... | ................. | .V........F...... | ...... | ........... | NPRGE...RS.A | 0.05 | 6 |
| ..... | ................. | ................. | ...NDR | ........... | A..A....... | 0.05 | 6 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | .................. | ...NGR | .DAG.S.A..DR | A..A........ | 0.05 | 6 |
| ..... | F.....NR..N..I.T.G | .QD......DF..P.... | G..K.. | ........... | A..A........ | 0.05 | 6 |
| GT... | .................. | ..HG.....NF......T | E..DD. | ........... | A..A........ | 0.05 | 6 |
| ..... | .................. | .................. | ...DDR | ..AS..D.AVGH | A..A........ | 0.05 | 6 |
| RA... | .................. | TQ..H....NF....... | ...... | E.ANG...E.G. | A..A........ | 0.05 | 6 |
| ..... | .................. | .................. | R..DG. | ........... | A..A........ | 0.05 | 6 |
| GT... | .................. | .................. | ...DD. | EDTTGG.....G | A..A........ | 0.05 | 6 |
| ..... | F.....SN..PL.K.T.. | .V........F....... | ...... | ........... | ........... | 0.05 | 6 |
| ..... | .................. | TKDT.....NF....... | ...... | ........... | A..A........ | 0.05 | 6 |
| G.... | F......KT.NV.K.T.H | .Q.DR.....F....... | ....D. | ........... | A..A........ | 0.05 | 6 |
| DA... | F.....GNG.HV.H.G.R | .........DF....... | ...... | ........... | ........... | 0.05 | 6 |
| ..... | F................. | .V........F....... | ...... | ........... | TH.NR..FT..E | 0.05 | 6 |
| TA... | .................. | TQYDR....NF....... | R...D. | ........... | A..A........ | 0.05 | 6 |
| NA... | F.....NA..RM.M.K.. | ..DGE....DF....... | ...DDR | ........... | A..A........ | 0.05 | 6 |
| ..... | .................. | .........DF......T | ...DDR | E.TS.D..AFDQ | A..A........ | 0.05 | 6 |
| ..... | .................. | .................. | ...D.. | .SGK.SDI.VDD | A..A........ | 0.05 | 6 |
| ..... | F.....GEG.L..T.K.G | ..PNG....DF....... | ...NGR | ........... | A..A........ | 0.05 | 6 |
| ..... | F................. | .V........F....... | ...... | ........... | GRSNT..D.A.. | 0.05 | 6 |
| ..... | .................. | .................. | R..ND. | EDGAAA....GQ | A..A........ | 0.05 | 6 |
| ..... | .................. | .................. | ...NG. | ........... | A..A........ | 0.05 | 6 |
| AA... | F................. | .QDT.....DF....... | G..DG. | .SATAN.I..DQ | A..A........ | 0.05 | 6 |
| E.... | .................. | .................. | ...... | ........... | A..A........ | 0.05 | 6 |
| ..... | .................. | ..HG.....NF......T | E..DD. | ........... | ........... | 0.05 | 6 |
| ..... | F.....GQG.IA.....K | .QAS......F....... | ...... | ...TG.D.AY.G | A..A........ | 0.05 | 6 |
| NA..T | .................. | ..HG.....NF......T | ...A.. | EDAG.AD.E.G. | A..A........ | 0.05 | 6 |
| RA... | .................. | .................. | ...... | .DTG.GD.A..H | A..A........ | 0.05 | 6 |
| AT..T | .................. | .........DF.WGATK | ...DD. | ..AKG.D.AYDG | A..A........ | 0.05 | 6 |
| ..... | .................. | .................. | R..DDR | E.AGES.A.Y.Q | A..A........ | 0.05 | 6 |
| GA... | F.....STA..Q.H.Q.L | T.P......DF....... | ...D.. | .S.KA..TE.DS | A..A........ | 0.05 | 6 |
| ..... | .................. | .........NF....... | R..DD. | EN..EG....DS | A..A........ | 0.05 | 6 |
| G.... | .................. | .........NF....... | R...D. | .NAGA.D.AFDE | A..A........ | 0.05 | 6 |
| GT..T | F.....GNG.HV.H.G.R | .Q.G......F....... | ...DD. | ........... | A..A........ | 0.05 | 6 |
| ..... | .................. | .................. | G..AD. | .N..TN.....G | A..A........ | 0.05 | 6 |
| ..... | .................. | .................. | ...... | ...ARAD.AY.G | A..A........ | 0.05 | 6 |
| TA... | F.....AQ...A.L.... | .QD.E.....F..P.... | ...... | ........... | ........... | 0.04 | 5 |
| A.... | F.....GNG.SL.M...I | ..DGE....DF....... | ...... | ........... | A..A........ | 0.04 | 5 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| TT..T | .................. | .................. | ...DDR | ............ | ............ | 0.04 | 5 |
| ..... | .................. | .................. | R..DD. | .DTA.A.AA.GE | A..A........ | 0.04 | 5 |
| A.... | F.....SR..IK.T.H.G | .QANH.....F......T | E..T.. | E.AGAND.AV.H | A..A........ | 0.04 | 5 |
| ..... | F................. | .V........F....... | ...... | ............ | .TRNE..VH... | 0.04 | 5 |
| ..... | .................. | .................. | R...G. | ESAA.D..E.GN | A..A........ | 0.04 | 5 |
| ..... | .................. | .................. | ...DDR | E.AARS...Y.H | A..A........ | 0.04 | 5 |
| ..... | F................. | .V........F....... | ...... | ............ | GNRDG..ASE.Q | 0.04 | 5 |
| D...T | F.....NGG.HV.....L | TQ.TG....DF....... | ...DDR | ..TGRS..E.GS | A..A........ | 0.04 | 5 |
| ..... | .................. | .................. | ...KDR | ............ | A..A........ | 0.04 | 5 |
| SA..T | F.....S.A.IA.M.T.R | .Q.DR.....F....... | ....D. | ............ | A..A........ | 0.04 | 5 |
| ..... | .................. | .................. | ...ND. | ..AKG...AV.. | A..A........ | 0.04 | 5 |
| G.... | F.....AAG.S..P...R | TKDDR....DF....... | ...DDR | .STAG.D..FDQ | A..A........ | 0.04 | 5 |
| GT... | F.....AEG.LK.M.H.L | ..DGE....DF....... | R...D. | ............ | ............ | 0.04 | 5 |
| HA... | F.....GKT.SL...G.R | ..A......DF....... | ...DG. | ENANGN.IAFD. | A..A........ | 0.04 | 5 |
| ..... | F.....DA..IA.L.K.R | .KDSR....DF......T | R...DD | ............ | A..A........ | 0.04 | 5 |
| ..... | F................. | TKDDR....DF....... | ...DDR | ............ | A..A........ | 0.04 | 5 |
| AT... | .................. | .................. | ...... | ............ | A..A........ | 0.04 | 5 |
| AT... | F.....DRG.S..T.A.S | .V........F....... | ...... | ............ | A..A........ | 0.04 | 5 |
| ..... | .................. | .................. | ...... | ESADRSD..Y.H | A..A........ | 0.04 | 5 |
| TA... | .................. | ..HG.....NF......T | E..DD. | EDGGGS..EYGS | ............ | 0.04 | 5 |
| ..... | F................. | .V........F....... | ...... | ............ | TRRDG..I.S.E | 0.04 | 5 |
| ..... | .................. | .................. | R...D. | .DTA.G.AAVDQ | A..A........ | 0.04 | 5 |
| ..... | .................. | .QPN......F.....ST | ....D. | ....E.....GH | A..A........ | 0.04 | 5 |
| ..... | .................. | .................. | ...DDR | E.A.AN..AVGD | A..A........ | 0.04 | 5 |
| ..... | .................. | .................. | ...N.. | ESAAASD..VGQ | A..A........ | 0.04 | 5 |
| ..... | .................. | .................. | R..ND. | ES.TG.DA..DQ | A..A........ | 0.04 | 5 |
| ..... | .................. | ........DF......T | ...D.. | E.AGEG.I...R | A..A........ | 0.04 | 5 |
| ..... | .................. | ........DF....... | ...... | ..T.GG.IEVDD | A..A........ | 0.04 | 5 |
| DT... | .................. | .Q.GQ....DF....... | R...D. | ............ | A..A........ | 0.04 | 5 |
| ..... | F.....SA..RA.....R | .KPDQ.....F....... | ...DDR | ENAGRSDIE.GQ | A..A........ | 0.04 | 5 |
| ..... | .................. | .Q.DR.....F....... | ....D. | ............ | A..A........ | 0.04 | 5 |
| T...T | .................. | .V........F....... | ...... | ESGGTD....DR | A..A........ | 0.04 | 5 |
| RA... | .................. | TKDDR....DF....... | ...DDR | ...ARD.IA..G | A..A........ | 0.04 | 5 |
| ..... | .................. | .................. | ...DDR | .D...S..A.GG | A..A........ | 0.04 | 5 |
| GT... | F................. | .V........F....... | ...... | ............ | ST.SA..FGV.A | 0.04 | 5 |
| GT..T | .................. | ...T.....NF....... | ....D. | ............ | A..A........ | 0.04 | 5 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| NT..T | .................. | TQ.GR....NF....... | ...... | ........... | A..A........ | 0.04 | 5 |
| ..... | F................. | .V........F....... | ...... | ........... | TARCA..ASA.E | 0.04 | 5 |
| ..... | .................. | TQ.TG....DF....... | ...DDR | .SGREGDAE..D | A..A........ | 0.04 | 5 |
| ..... | F.....GRG.H..P.E.R | .V........F....... | R.A... | ........... | A,.A........ | 0.04 | 5 |
| A.... | F.....DD..IH.K.K.K | .Q.DR.....F....... | ....D. | ..AT..DIA.DR | A..A........ | 0.04 | 5 |
| RA... | .................. | .................. | E..KD. | ........... | ............ | 0.04 | 5 |
| T.... | .................. | .QD.E.....F..P.... | ...D.. | ........... | ............ | 0.04 | 5 |
| D.... | F................. | .QPSR.....F......T | ...D.. | E.ATG...A.G. | A..A........ | 0.04 | 5 |
| ..... | .................. | ..HG.....NF......T | ...A.. | ........... | A..A........ | 0.04 | 5 |
| ..... | .................. | .................. | ...D.. | EDAGT..AA..H | A..A........ | 0.04 | 5 |
| SA..T | F.....AGT..M.K.Q.G | .Q.GQ....DF....... | R..DG. | .NAAR.D.A.GE | A..A........ | 0.04 | 5 |
| ..... | F.....GG..NK.M.... | .KPSE....DF......T | R...DR | ........... | A..A........ | 0.04 | 5 |
| ..... | .................. | .................. | ...KG. | ........... | A..A........ | 0.04 | 5 |
| ..... | .................. | .................. | ....GR | ..AG.N.AA.GQ | ............ | 0.04 | 5 |
| RA... | .................. | .Q.DR.....F....... | ....D. | EDTG.A....GN | A..A........ | 0.04 | 5 |
| GT..T | F.....AAG.HV.I...K | ..DGE....DF....... | ...... | ........... | A..A........ | 0.04 | 5 |
| ..... | F................. | .................. | E..KG. | ........... | A..A........ | 0.04 | 5 |
| G.... | F.....DRG..M...K.R | .V........F....... | ...... | ..AATD.AA.DQ | A..A........ | 0.04 | 5 |
| ..... | .................. | ........DF....... | ...... | ES.DRN.....Q | A..A........ | 0.04 | 5 |
| ..... | .................. | TQ.TG....DF....... | ...DDR | ........... | A..A........ | 0.04 | 5 |
| D...T | .................. | .................. | G..K.. | ...A.SD.AY.G | A..A........ | 0.04 | 5 |
| E.... | .................. | .Q......DF....... | ...AD. | ..NAAS.AE.GE | A..A........ | 0.04 | 5 |
| E.... | .................. | .................. | ...N.. | ........... | A..A........ | 0.04 | 5 |
| ..... | F................. | .V........F....... | ...... | ........... | APRAP..IR..A | 0.04 | 5 |
| ..... | F................. | .V........F....... | ...... | ........... | NHRNT..D.E.A | 0.04 | 5 |
| ..... | F.....aqg.nv.h.k.r | .QYGQ....DF....... | ...... | E........... | ............ | 0.04 | 5 |
| GT... | F.....GG..LL.H.G.R | .QPN......F......T | ...N.. | ........... | A..A........ | 0.04 | 5 |
| GT... | F......KG.NL...Q.S | .QPG.....NF....... | ...DDR | ........... | A..A........ | 0.04 | 5 |
| ..... | .................. | .................. | R...D. | EDASTNDAAY.Q | A..A........ | 0.04 | 5 |
| NT... | .................. | ..YN......F......T | ...D.R | ........... | A..A........ | 0.04 | 5 |
| A.... | .................. | .........NF....... | R...D. | ..TGTS...YGS | A..A........ | 0.04 | 5 |
| E.... | .................. | .................. | R..DD. | ........... | A..A........ | 0.04 | 5 |
| HA... | F.....SN..PLKK.T.. | .Q......DF....... | E..N.. | ........... | A..A........ | 0.04 | 5 |
| DA..T | F.....DS..NH.I.P.R | .Q.DH....NF....... | ...DD. | ..AAE.D....N | A..A........ | 0.04 | 5 |
| ..... | .................. | .........NF....... | E..N.. | ES.GAN..EVDG | A..A........ | 0.04 | 5 |
| AT..T | F.....NTG.RN.T.T.L | .........NF....... | R...D. | ...AAS.A.VGQ | A..A........ | 0.04 | 5 |

TABLE 3-continued

AAV capsid proteins having increased specificity for and/or transduction of CD447−/133− GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................ | .........DF....... | E..AD. | .SAKGG..EYGD | A..A........ | 0.04 | 5 |
| ..... | F............... | .V........F....... | ...... | ............ | GRSSG..DTN.D | 0.04 | 5 |
| GA... | ................ | ..DGE....DF....... | E..AD. | ............ | A..A........ | 0.04 | 5 |
| GT... | F............... | .V........F....... | ....V. | ............ | ............ | 0.04 | 5 |
| PA..T | F............... | ................ | ...DD. | ............ | A..A........ | 0.04 | 5 |
| ..... | ................ | ................ | ...DDR | E.A......... | A,.A........ | 0.04 | 5 |
| ..... | F............... | .V........F....... | ...... | ............ | DPRAS..SSA.. | 0.04 | 5 |
| ..... | ................ | ................ | R...D. | E.TNESDT..D. | A..A........ | 0.04 | 5 |
| D.... | F.....SK..PA.K.A.G | ..A......DF....... | ...DG. | .N.GRS..E.G. | A..A........ | 0.04 | 5 |
| EA..T | ................ | T.P......DF....... | ...D.. | .SGS.NDIA..D | A..A........ | 0.04 | 5 |
| ..... | F............... | .V........F....... | ...... | ............ | TTRAT..DKI.D | 0.04 | 5 |
| NA... | F.....GRT.PQ.T.T.R | ..DGE....DF....... | R..... | .N.GA.D.A.GG | A..A........ | 0.04 | 5 |
| ..... | F............... | .V........F....... | ...... | ............ | DTRGR..DRI.H | 0.04 | 5 |
| ..... | F............... | ...T.....NF....... | ...... | .SAS.N.IA..E | A,.A........ | 0.04 | 5 |
| ..... | F............... | ..........F....... | ...... | ............ | GPQDG..ADE.H | 0.04 | 5 |
| A...T | ................ | TQP.R....NF......T | ...D.. | ............ | A..A........ | 0.04 | 5 |
| GA..T | ................ | .Q.DH....NF....... | ...DD. | ............ | A..A........ | 0.04 | 5 |
| ..... | ................ | ................ | ...D.. | E.TAGN.IE.DG | A..A........ | 0.04 | 5 |
| TA..T | F.....GN..HM.P.... | ...NG....DF....... | ...D.. | ............ | A..A........ | 0.04 | 5 |
| R...T | F.....DTA..D.K...K | .KYT.....NF......T | R..TDR | ............ | A..A........ | 0.04 | 5 |
| ..... | F............... | .V........F....... | ...... | ............ | GTRAT..IH..D | 0.04 | 5 |
| ..... | F............... | .V........F....... | ...... | ............ | TPRAP..VRG.E | 0.04 | 5 |
| ..... | ................ | ................ | ...DD. | .NGST.....GG | A..A........ | 0.04 | 5 |
| ..... | ................ | ..ADH....DF....... | G..A.R | ............ | A..A........ | 0.04 | 5 |
| .A... | F.....A.G.RV.T.A.G | .QD.E.....F..P.... | ....G. | E.TGRND.A..E | A..A........ | 0.04 | 5 |
| ..... | ................ | .Q.GQ....DF....... | ....G. | ............ | A..A........ | 0.04 | 5 |
| ..... | ................ | ................ | R...D. | ESAG...TEYD. | A..A........ | 0.04 | 5 |
| ET... | F.....NGG.NN.K.T.R | ................ | ...... | ............ | A..A........ | 0.04 | 5 |
| DT... | F.....NTG.RN.T.T.L | .Q.GQ....DF....... | E..AG. | ............ | A..A........ | 0.04 | 5 |
| ..... | ................ | ................ | G..TG. | ES.DRN.....Q | A,.A........ | 0.04 | 5 |
| ..... | ................ | ....E....DF......T | R..DG. | .N.AEA..AYDD | A..A........ | 0.04 | 5 |
| ..... | F............... | .QANH....DF....... | ...DDR | ............ | A..A........ | 0.04 | 5 |
| ..... | ................ | ................ | R..DG. | ESAAR..IE.DE | A..A........ | 0.04 | 5 |
| E.... | F.....AGG.P..L...G | .V........F....... | ...... | EN.GE..IA.DR | ............ | 0.04 | 5 |
| ..... | ...............H | .QPN......F......T | ...D.. | EDAAGNDIE.G. | A..A........ | 0.04 | 5 |
| G.... | F.....ASA.PN.P.... | .QDT.....DF....... | R...D. | EDAG.AD.E.G. | A..A........ | 0.04 | 5 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F................ | .V........F....... | ...... | ........... | GPRGH...TN.D | 0.04 | 5 |
| NT..T | F......HG.LV.L.K.R | .QAS......F....... | ...... | ........... | A...A........ | 0.04 | 5 |
| TA..T | F.....SRA.SK.N.A.H | .Q.D.....DF..P.... | ...... | ........... | A...A........ | 0.04 | 5 |
| .T... | ................ | ..PDH....DF....... | ...DDR | EN.TTG.IEVDR | A...A........ | 0.04 | 5 |
| ..... | ................ | ................ | R...D. | .DAAAN.IE.DR | A...A........ | 0.04 | 5 |
| G.... | F.....A.A.NH.I.Q.G | .........NF....... | R...D. | ..AGAN...FGE | A...A........ | 0.04 | 5 |
| ..... | ................ | ..HG.....NF......T | ...A.. | .STSRGD...GG | A...A........ | 0.04 | 5 |
| ..... | F................ | .V........F....... | ...... | ........... | GARTH..YTE.A | 0.04 | 5 |
| ..... | ................ | ................ | ...NG. | ........... | ............ | 0.04 | 5 |
| ..... | F................ | .V........F....... | ...... | ........... | ETHGP..DHI.. | 0.04 | 5 |
| ..... | ................ | ................ | ...D.R | .NGST.....GG | A...A........ | 0.04 | 5 |
| NA..T | F.....G.G.HA.T.G.R | ...TE.....F......T | ...NGR | ..ATESD..FDQ | A...A........ | 0.04 | 5 |
| ..... | ................ | ........DF....... | ...AGR | ..A...AD.AYGQ | A...A........ | 0.04 | 5 |
| AT... | ................ | ........DF....... | ...DD. | ........... | ............ | 0.04 | 5 |
| .A... | F................ | .V........F....... | ...DDR | ED.GAG..AV.G | A...A........ | 0.04 | 5 |
| A.... | F.....ATA.NK.T.A.R | .........NF....... | R...D. | E.ANGG.A...D | A...A........ | 0.04 | 5 |
| RT... | ................ | TKPTQ....NF......T | ...D.R | ........... | A...A........ | 0.04 | 5 |
| TT... | F......AG.NV.N.S.R | .QAS.....NF......T | ...N.. | ........... | A...A........ | 0.04 | 5 |
| ..... | ................ | ................ | ...... | ESATGG.T..GG | A...A........ | 0.04 | 5 |
| TA... | F.....AG..RV.L.N.G | .V........F....... | ...... | EN.G.A.....Q | A...A........ | 0.04 | 5 |
| ..... | ................ | ................ | ...... | .STT.S..A.GG | A...A........ | 0.04 | 5 |
| ..... | ................ | ................ | E..ND. | .DADGD...VDQ | A...A........ | 0.04 | 5 |
| GT... | F.....DGG.LA.K...R | ..AGR.....F......T | ...... | ........... | A...A........ | 0.04 | 5 |
| ..... | ................ | ................ | ....D. | ...DGSDT..GG | A...A........ | 0.04 | 5 |
| ..... | ................ | ........DF......T | G..KGR | ........... | A...A........ | 0.04 | 5 |
| ..... | F................ | .V........F....... | ...... | ........... | AKSG...D.R.D | 0.04 | 5 |
| SA... | F.....NR..N..I.T.G | ..YGG.....F....... | E..KD. | .DAGGN.IAV.E | A...A........ | 0.04 | 5 |
| G.... | ................ | ................T | ...... | .SA....AA.GH | A...A........ | 0.04 | 5 |
| TA... | F.....AQ...A.L.... | .QD.E.....F..P.... | ...... | ........... | T.RAS..SKE.Q | 0.04 | 5 |
| ..... | ................ | ................T | G..TDR | ........... | ............ | 0.04 | 5 |
| RA... | F................ | .KAS.....NF......T | ...AD. | ........... | A...A........ | 0.04 | 5 |
| ..... | ................ | ................ | ...DDR | ...RGN...YGG | A...A........ | 0.04 | 5 |
| E.... | F.....AA..RM.P.G.. | .........NF....... | R...D. | ...AAS.A.VGQ | A...A........ | 0.04 | 5 |
| ..... | ................ | ................ | E..TD. | ........... | ............ | 0.04 | 5 |
| ..... | ................ | ................ | ...D.. | .DGSGG.TE.DG | A...A........ | 0.04 | 5 |
| EA... | F.....GTG..P.T.D.R | .QPSE....DF....... | ...DDR | ........... | ............ | 0.04 | 5 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| .A... | F.....DHA.N..P.Q.K | TQPTH....NF....... | R..DD. | .SATGS....DQ | A..A........ | 0.04 | 5 |
| ..... | ................. | ..........F......T | ...DG. | .DG.G.DI..DR | A..A........ | 0.04 | 5 |
| TT... | ................. | ................. | ...KD. | ........... | ........... | 0.04 | 5 |
| ..... | ................. | ..........NF....... | ...DDR | ...DGSDT..GG | A..A........ | 0.04 | 4 |
| ..... | ................. | ................. | R..... | E..SRND...DR | A..A........ | 0.04 | 4 |
| AA... | ......NKG.NL.N.T.E | ..DGE....DF....... | ...... | ........... | A..A........ | 0.04 | 4 |
| TT... | F.....SSA.LD.T.A.. | .V........F....... | ...... | ........... | ........... | 0.04 | 4 |
| ..... | F................ | .V........F....... | ...... | ........... | N.HSA...GE.K | 0.04 | 4 |
| ..... | F.....A...ND.T...K | .Q.DH....NF....... | ...DD. | ........... | A..A........ | 0.04 | 4 |
| ..... | ................. | ................. | ...DDR | .DGGGS.....G | A..A........ | 0.04 | 4 |
| SA..T | F................ | .V........F....... | ...... | ........... | ARHDR..SET.E | 0.04 | 4 |
| ..... | ................. | ..HG.....NF......T | ...... | ........... | ........... | 0.04 | 4 |
| SA... | F......S..PM.T.S.K | ..A......DF....... | ...DG. | .DAG.A.I..DG | A..A........ | 0.04 | 4 |
| ..... | ................. | ................. | R..DD. | ES.DRN..A.DN | A..A........ | 0.04 | 4 |
| SA... | ................. | .V........F....... | ...... | ........... | GNRDP..A.E.E | 0.04 | 4 |
| ..... | ................. | ................. | ...ADR | ..AGAN...FGQ | A..A........ | 0.04 | 4 |
| ..... | F................ | .V........F....... | ...... | ........... | T..GG......P | 0.04 | 4 |
| ..... | ................. | ..DGE....DF....... | ...... | ........... | A..A........ | 0.04 | 4 |
| GT..T | F.....SG..RV.I.G.R | .QANH....DF....... | R...D. | E.AATSDIE.DR | A..A........ | 0.04 | 4 |
| ..... | F.....SKG.NV.L.G.G | .V........F....... | ...... | ........... | A..A........ | 0.04 | 4 |
| SA..T | F......AT.I..N.K.G | ..PNG....NF....... | ...DD. | ........... | A..A........ | 0.04 | 4 |
| ..... | ................. | ........DF......T | R..AGR | ED.KAS.I...G | A..A........ | 0.04 | 4 |
| RA... | F.......KT.NK..A.G | .V........F....... | ...ND. | ..AAE.D....N | A..A........ | 0.04 | 4 |
| A...T | ................. | ...V.....NF....... | R...D. | ........... | A..A........ | 0.04 | 4 |
| HT..T | F.....ARG.IA.K.E.R | .Q.DH....NF....... | ...DD. | ........... | A..A........ | 0.04 | 4 |
| SA... | ................. | ................. | ...DG. | ...GGND...GG | A..A........ | 0.04 | 4 |
| ..... | ................. | ................. | ...... | ..TA.N..A.GG | A..A........ | 0.04 | 4 |
| ..... | F.......G.HK.T.N.G | .Q.DH....NF....... | ...DD. | E.AGAND.AY.N | A..A........ | 0.04 | 4 |
| ..... | ................. | ................. | R...D. | EDAA...AAVDQ | A..A........ | 0.04 | 4 |
| ..... | F................ | .V........F....... | ...... | ........... | GHRTG..D.T.H | 0.04 | 4 |
| AA... | F.....AN...N.L.H.R | ..........F....... | ...... | .SASRND.AVGE | A..A........ | 0.04 | 4 |
| T.... | F......TG.IL...T.R | ..YN......F......T | ...D.R | ........... | A..A........ | 0.04 | 4 |
| SA... | ................. | .QPSQ....NF....... | E..TGR | .DTGRN..E.DS | A..A........ | 0.04 | 4 |
| ..... | ................. | ................. | ...D.. | EN.GGSD.E.DE | A..A........ | 0.04 | 4 |
| ..... | ................. | ................. | ...DD. | .S.AGND..VDN | A..A........ | 0.04 | 4 |
| AA... | ................. | TQ.TG....DF....... | ...DDR | .NTGGG....DG | A..A........ | 0.04 | 4 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | ................. | .................T | ...D.R | E.GG.N.I.F.E | A..A........ | 0.04 | 4 |
| GT... | ................. | ..DGE....DF....... | R...D. | ............ | A..A........ | 0.04 | 4 |
| ET... | F.....ASA.SV.H.T.G | ..DGE....DF....... | ...... | .SAAGAD.A.DS | A..A........ | 0.04 | 4 |
| N.... | ................. | ................. | ...DDR | ............ | A..A........ | 0.04 | 4 |
| ..... | ................. | ................. | ...D.. | EDAA...AAVDQ | A..A........ | 0.04 | 4 |
| ..... | ................. | ................. | ....D. | ..GG...I..GH | A..A........ | 0.04 | 4 |
| ..... | ................. | ..E......NF......T | G..N.. | ..TK.GD..FGQ | A..A........ | 0.04 | 4 |
| ET..T | F.....SGG.IN.H.... | .........NF....... | R...D. | EDAGT...AFD. | A..A........ | 0.04 | 4 |
| NA... | F.....NGG.LN.I.G.R | .KYT.....NF......T | G..DD. | EDAAR.D.A.D. | A..A........ | 0.04 | 4 |
| ..... | .................K | ..DGE....DF....... | ...DGR | .SGTGDDT.VDG | A..A........ | 0.04 | 4 |
| ..... | ................. | ................. | G..KGR | ............ | A..A........ | 0.04 | 4 |
| ..... | ................. | ................. | ....G. | EDAGT...AFD. | A..A........ | 0.04 | 4 |
| ..... | F................ | .V........F....... | ...... | ............ | .DRDE..VGG.. | 0.04 | 4 |
| ..... | ................. | ................. | ...DD. | ...TAAD..V.E | A..A........ | 0.04 | 4 |
| ..... | F................ | .V........F....... | ...... | ............ | KRHSG..FSV.D | 0.04 | 4 |
| ..... | ................. | .RPT.....DF....... | E..N.. | .S.SGN.I..GH | A..A........ | 0.04 | 4 |
| ..... | F.....NS..SA.H.Q.G | ..HG.....NF......T | ...A.. | ..AG.SD...GR | A..A........ | 0.04 | 4 |
| ..... | F................ | .V........F....... | ...... | ............ | DPRAA..AGV.T | 0.04 | 4 |
| ..... | ................. | ................. | ....D. | ...R.ND.A.GG | A..A........ | 0.04 | 4 |
| ..... | ................. | ................. | R...D. | .S.RT...A.DD | A..A........ | 0.04 | 4 |
| ..... | ................. | ................. | ...DD. | E.TGAN.AE.GE | A..A........ | 0.04 | 4 |
| DT... | ................. | ..HG.....NF......T | ...A.. | ............ | A..A........ | 0.04 | 4 |
| AA..T | F.....D.A.HA...G.R | ..P.G....KF....... | ...D.. | ............ | ............ | 0.04 | 4 |
| RT... | F.....GKG.S..M.K.M | .........NF....... | R...D. | EDAG.AD.E.G. | CD.A........ | 0.04 | 4 |
| D...T | F.....NGG.HN.K.G.E | ..YN......F......T | ...D.R | ............ | A..A........ | 0.04 | 4 |
| N.... | ................. | ................. | ...DDR | ............ | ............ | 0.04 | 4 |
| ..... | F................ | .V........F....... | ...... | ............ | ATRNT..VDV.H | 0.04 | 4 |
| ..... | ................. | ................. | R..DG. | ..AG.DD...GG | A..A........ | 0.04 | 4 |
| ..... | ................. | ...T......F....... | R...D. | ENGKTA..A.DR | A..A........ | 0.04 | 4 |
| ..... | ................. | .PDNR..T.DF......T | ....GR | ............ | A..A........ | 0.04 | 4 |
| DT... | ................. | ................. | R..N.. | ............ | ............ | 0.04 | 4 |
| ..... | ................. | ..P.G....KF....... | ...D.R | ............ | A..A........ | 0.04 | 4 |
| ..... | F................ | .V........F....... | ...... | ............ | S.RGP..ART.D | 0.04 | 4 |
| ..... | ................. | ..DDR.....F....... | ...... | .STAEG...F.. | A..A........ | 0.04 | 4 |
| ..... | ................. | .QPN......F......T | ...N.. | .D.GGSD.AYDR | A..A........ | 0.04 | 4 |
| RA... | F................ | .PPNG.....F......T | ...DDR | EDASG....FDR | A..A........ | 0.04 | 4 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| RA... | F.....NNA.HK.T.D.R | ..........F....... | ....D. | ...DTN..E.DR | A..A........ | 0.04 | 4 |
| HT... | F.....DRG.S..T.A.S | .V........F....... | ...... | ............ | A..A........ | 0.04 | 4 |
| ..... | .................. | .................. | .DDR | .D.GRA...F.. | A..A........ | 0.04 | 4 |
| T...T | F......G..NL.T.E.R | .........NF....... | R...D. | E.AKAADAAYDE | A..A........ | 0.04 | 4 |
| RA..T | F.....DGA.R..P.A.K | .........NF....... | R...D. | ............ | A..A........ | 0.04 | 4 |
| GA... | F.....AEG.LK.M.H.L | ..DGE....DF....... | R...D. | ............ | A..A........ | 0.04 | 4 |
| TT... | F.....AE...A.T...R | .QPN......F....... | ...A.. | ............ | A..A........ | 0.04 | 4 |
| ..... | .................. | .KYT.....DF....... | ...KGR | .DAS.N...VDG | A..A........ | 0.04 | 4 |
| D...T | F.....DRG.S..T.A.S | .QHGG.....F....... | ...... | ..AGADD...DQ | A..A........ | 0.04 | 4 |
| TA... | .................. | ..HG.....NF......T | ...DDR | ............ | A..A........ | 0.04 | 4 |
| AA... | F.....DQ..R..P.S.R | T.P......DF....... | ...D.. | .DANTN.A.VDS | A..A........ | 0.04 | 4 |
| ..... | .................. | .................. | ...DDR | EDTAGA....DR | A..A........ | 0.04 | 4 |
| ..... | .................. | .................. | R...D. | ..TG.N.IAF.D | A..A........ | 0.04 | 4 |
| ..... | F.....ASA.S..T.T.G | .QPG.....DF....... | ...... | ............ | A..A........ | 0.04 | 4 |
| E.... | F.....ASA.S..T.T.G | .................. | ...... | ............ | ............ | 0.04 | 4 |
| E.... | F......KT.NV.K.T.H | ..YN......F......T | ...D.R | ............ | A..A........ | 0.04 | 4 |
| ..... | ......AEG.LK.M.H.L | ..DGE....DF....... | ...... | ............ | ............ | 0.04 | 4 |
| ..... | .................. | .................. | ...DD. | .DTA.A.AA.GE | A..A........ | 0.04 | 4 |
| ..... | .................. | .................. | R..N.. | ..AKAND...GS | A..A........ | 0.04 | 4 |
| AA... | F.....ATT.NV.T.G.R | .QPTR....DF....... | E..NG. | ENATASD...GS | A..A........ | 0.04 | 4 |
| ..... | F.....GQ..LN.L.D.R | ..A......DF....... | R...G. | ..ARRS.A.FDD | A..A........ | 0.04 | 4 |
| ..... | .................. | .................. | G..DG. | ............ | A..A........ | 0.04 | 4 |
| ..... | .................. | .........NF....... | ...N.. | ESARGSD.A.DE | A..A........ | 0.04 | 4 |
| ..... | .................. | .................. | ...D.. | .DASGS....GG | A..A........ | 0.04 | 4 |
| GT... | F.....AEG.LK.M.H.L | ..DGE....DF....... | ...N.. | ............ | A..A........ | 0.04 | 4 |
| GT... | F.....STA.HA.M.S.V | ..DGE....DF....... | ...... | .SAKAA.AA.DE | A..A........ | 0.04 | 4 |
| E.... | F.....NA..PI.P.P.R | ..DGE....DF....... | ...... | ............ | A..A........ | 0.04 | 4 |
| ....T | F.....GGG.LD.T...R | T.P......DF....... | ...D.. | ESGG.G..E..Q | A..A........ | 0.04 | 4 |
| A...T | F.....DNT.SK.L...K | ..DGE....DF....... | ...... | E.AAGD.I.V.R | A..A........ | 0.04 | 4 |
| NA... | .................. | TKHGG....NF....... | ...D.. | E.GDGS...F.R | A..A........ | 0.04 | 4 |
| ..... | .................. | .................. | ...... | .SAKAA.AA.DE | A..A........ | 0.04 | 4 |
| ..... | .................. | .................. | R..D.R | ESTKR....VGE | A..A........ | 0.04 | 4 |
| ..... | .................. | .................. | ....GR | ............ | ............ | 0.04 | 4 |
| ..... | .................. | .................. | G..TDR | E..K.NDAEVGQ | A..A........ | 0.04 | 4 |
| ..... | .................. | .........NF......T | R..AD. | ............ | A..A........ | 0.04 | 4 |
| SA... | F......GG.NA.H.Q.R | .V........F....... | ...... | ..AAA.....GR | A..A........ | 0.04 | 4 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| G...T | F.....DRG.H..L.S.L | .V........F....... | ...... | .......... | A..A........ | 0.04 | 4 |
| RT... | ................. | ..ATR....DF....... | E..N.. | E..RRA.....Y | A..A........ | 0.04 | 4 |
| ..... | ................. | ................. | ....GR | .STAAG...VDG | A..A........ | 0.04 | 4 |
| GA... | F.....S.A.N..L...L | .V........F....... | R...D. | E.AAGSD..... | A..A........ | 0.04 | 4 |
| ..... | F................. | .V........F....... | ...... | .......... | GRRAT..DDA.. | 0.04 | 4 |
| ..... | ................. | .........DF....... | ...DG. | .NGGGD....GR | A..A........ | 0.04 | 4 |
| ..... | F................. | .V........F....... | ...... | .......... | GTQSR..DRG.. | 0.04 | 4 |
| ..... | ................. | .........DF....... | ...D.. | .S.KA..TE.DS | A..A........ | 0.04 | 4 |
| ..... | ................. | ................. | ....D. | ES.TGSD..VDR | A..A........ | 0.04 | 4 |
| SA..T | F......TG.IL...T.R | .QAS.....NF......T | ....GR | .DAGA.D.EVDE | ............ | 0.04 | 4 |
| AT... | F.....GTG..P.T.D.R | ..DGE....DF....... | ...ND. | ENAAGGDT..GR | A..A........ | 0.04 | 4 |
| SA... | F.....AQ...A.L.... | T.P......DF....... | ...DDR | ENTKGD....D. | A..A........ | 0.04 | 4 |
| ..... | F.....ARA.L..L.Q.G | ..DGE....DF....... | ...... | .......... | A..A........ | 0.04 | 4 |
| ....T | ................. | ................. | ...... | .......... | | 0.04 | 4 |
| ..... | ................. | .........NF....... | ...A.. | .......... | A..A........ | 0.04 | 4 |
| ..... | ................. | ................. | ....G. | ENAGR.DI..GS | A..A........ | 0.04 | 4 |
| ..... | F.....AQ...A.L.... | .QD.E.....F..P.... | ...... | .......... | ............ | 0.04 | 4 |
| ..... | ................. | ................. | R..TG. | ..TGAS.A..DH | A..A........ | 0.04 | 4 |
| GT... | F.....ASA.S..T.T.G | .QPG.....DF....... | ...DDR | .......... | A..A........ | 0.04 | 4 |
| RA... | F.....NGG.LN.I.G.R | TQPT.....DF....... | ...... | .NAAAN..EF.H | A..A........ | 0.04 | 4 |
| G...T | ................. | .KYT.....NF....... | ...NDR | ED.R.S.A...G | A..A........ | 0.04 | 4 |
| R.... | F.....GN..HM.P.... | .........DF....... | ....GR | .NAGASDA.FDQ | A..A........ | 0.04 | 4 |
| N.... | F.....NGG.NN.K.T.R | ..PN.....NF....... | ...NDR | .......... | A..A........ | 0.04 | 4 |
| SA... | F.....DRG.HA.T...G | .QPN......F......T | ...N.. | .......... | A..A........ | 0.04 | 4 |
| ..... | ................. | ................. | ...ADR | EDGDGA..A.DR | A..A........ | 0.04 | 4 |
| ..... | ................. | .Q.S.....NF......T | E..DD. | .......... | A..A........ | 0.04 | 4 |
| ..... | ................. | ................. | R...D. | .N.AGA.AEYDD | A..A........ | 0.04 | 4 |
| ..... | F................. | .V........F....... | ...... | .......... | .HRGG...D..T | 0.04 | 4 |
| TT..T | ......GRG.SP.K.M.G | .QPG.....NF....... | ...DDR | .......... | A..A........ | 0.04 | 4 |
| ..... | ................. | ................. | R..ND. | ..AG.N.AA.GQ | A..A........ | 0.04 | 4 |
| ..... | F................. | .V........F......T | ...N.. | ..TG.D..A.GG | APRDP....S.. | 0.04 | 4 |
| ..... | ................. | .QPN......F....... | ...... | .......... | A..A........ | 0.04 | 4 |
| ..... | F.....SAT.SM.K...R | .V........F....... | ...... | .......... | A..A........ | 0.04 | 4 |
| RT... | ................. | .KDDG....NF....... | ...... | E..RRA.....Y | A..A........ | 0.04 | 4 |
| ..... | ................. | ................. | G..TG. | .......... | A..A........ | 0.04 | 4 |
| .T..T | ................. | ................. | ....D. | .......... | A..A........ | 0.04 | 4 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | .................... | ...... | E.ASTA..A.GQ | A..A........ | 0.04 | 4 |
| NT... | F.....SAT.PV.T.Q.G | TQDGE....DF....... | ...DG. | ............ | A..A........ | 0.04 | 4 |
| ..... | ................. | .................... | ...... | E.AG..D.A.GR | A..A........ | 0.04 | 4 |
| E.... | ................. | .KYT.....NF....... | ...D. | ............ | ............ | 0.04 | 4 |
| ..... | ................. | .................... | ...D. | E.T..S..A..R | A..A........ | 0.04 | 4 |
| ..... | ................. | .................... | ...... | ............ | SARAP..VHN.A | 0.04 | 4 |
| G.... | F.....GRG.H..P.E.R | .KD.E.....F....... | ...D. | E..RG.D..FDG | A..A........ | 0.04 | 4 |
| ..... | ................. | T.PG.....NF....... | ...D.. | EN.TTG.IE.DR | A..A........ | 0.04 | 4 |
| ..... | ................. | .........DF......T | ....GR | E.TSGDD.EYDN | A..A........ | 0.04 | 4 |
| HT..T | ................. | .Q.DR.....F....... | ....D. | ............ | A..A........ | 0.04 | 4 |
| TT... | F.....SAG..L.P.P.. | .................... | ...... | ............ | A..A........ | 0.04 | 4 |
| ..... | ................. | .................... | ...DDR | .STAAG...VDG | A..A........ | 0.04 | 4 |
| ..... | ................. | .................... | E..DGR | ............ | ............ | 0.04 | 4 |
| ..... | F................ | .V........F....... | ...... | ............ | GARGN..AGR.D | 0.04 | 4 |
| NA... | F.....NR..N..I.T.G | .QYGQ....DF......T | E..NGR | ............ | A..A........ | 0.04 | 4 |
| GT... | F.....SRG..L.P.G.G | ..HG.....NF......T | ....GR | ............ | A..A........ | 0.04 | 4 |
| ..... | ................. | TKDDR....DF....... | ...DDR | .DAGRN.IA.DG | A..A........ | 0.04 | 4 |
| NA... | F.....DA..IA.L.K.R | .KPDQ.....F....... | ...DG. | ............ | A..A........ | 0.04 | 4 |
| ..... | ................. | .................... | ....D. | .DAGES..A.GD | A..A........ | 0.04 | 4 |
| RA... | F.....G.G.HV.H.G.R | .........NF....... | R...D. | .SAKAA.AA.DE | A..A........ | 0.04 | 4 |
| .A... | F.....D.T.HP.M...R | ..A......DF....... | ...DG. | .STSRGD...GG | A..A........ | 0.04 | 4 |
| ..... | ................. | .................... | E..KDR | ............ | ............ | 0.04 | 4 |
| ..... | F................ | .V........F....... | ...... | ............ | TPHGP..DEM.P | 0.04 | 4 |
| GT..T | F.....GT..NL.K.D.R | .Q.S......F....... | R..AD. | ..AA.D.IA... | A..A........ | 0.04 | 4 |
| E.... | F.....NGG.NN.K.T.R | .QPN......F......T | ...N.. | ............ | A..A........ | 0.04 | 4 |
| GT... | F.....DRG.SL.M...G | ..DGE....DF....... | ...... | ............ | A..A........ | 0.04 | 4 |
| T.... | F.....NGG.HV.....L | .KDDG....NF....... | ...DDR | ............ | A..A........ | 0.04 | 4 |
| ..... | F................ | .V........F....... | ...... | ............ | KD.GR..FGV.. | 0.04 | 4 |
| ..... | F.....A.T.NN.T.S.H | .........NF....... | R...D. | ............ | A..A........ | 0.04 | 4 |
| ..... | ................. | .........NF....... | ...ND. | EN.G.A.....Q | A..A........ | 0.04 | 4 |
| GA... | F.....DRA.N..P...L | ..HG.....NF......T | ...A. | ............ | A..A........ | 0.04 | 4 |
| .A... | ................. | .................... | R..DD. | ............ | ............ | 0.04 | 4 |
| ..... | F..I............. | .V........F....... | ...... | ............ | GP.GT..FNV.D | 0.04 | 4 |
| NA..T | ................. | ..HG.....NF......T | ...A. | ES.DRN.....Q | A..A........ | 0.04 | 4 |
| ..... | ................. | .................... | ...D.. | ES.NRD..A..G | A..A........ | 0.04 | 4 |
| S.... | F.....AAR..K.T.E.L | ..DGE....DF....... | ...... | EDGG.GDIA.DR | A..A........ | 0.04 | 4 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| TA... | F.....SGT.S..T.T.. | ..HG.....NF......T | ...A.. | ........... | A..A........ | 0.04 | 4 |
| ..... | .................. | ..YN......F......T | ...D.R | ........... | A..A........ | 0.04 | 4 |
| ..... | F................. | .V........F....... | ...... | ........... | DRQTK..SD... | 0.04 | 4 |
| A.... | .................. | .KPDQ.....F....... | ....G. | ...REGD...GQ | A..A.....G.. | 0.04 | 4 |
| E.... | F................. | .................. | R..AD. | ........... | A..A........ | 0.04 | 4 |
| KA... | F......S..SE.T...R | ..PNG....DF....... | G..NDR | .DGGGN.....R | A..A........ | 0.04 | 4 |
| R.... | F................. | ..ATG....NF..P...T | ...AD. | ........... | A..A........ | 0.04 | 4 |
| ..... | .................. | .................. | ...DG. | ..ARTADTE.DS | A..A........ | 0.04 | 4 |
| ..... | .................. | .V........F....... | ...DDR | ........... | A..A........ | 0.04 | 4 |
| GA... | .................. | ..HG.....NF......T | ...A.. | ..AA.SDI.... | A..A........ | 0.04 | 4 |
| ..... | .................. | TQ.TG....DF....... | ...DDR | ...AGS.IAFDG | A..A........ | 0.04 | 4 |
| ..... | F.....ARA.L..L.Q.G | .V........F....... | ...D.. | ........... | A..A........ | 0.04 | 4 |
| ..... | .................. | .................. | ...DDR | .STTGA...V.Q | A..A........ | 0.04 | 4 |
| ..... | .................. | .................. | R..A.. | ........... | A..A........ | 0.04 | 4 |
| ..... | F................. | .V........F....... | ...... | ........... | N.RAP..ATV.D | 0.04 | 4 |
| ..... | F................. | .V........F....... | ...... | ........... | ATRST...DE.A | 0.04 | 4 |
| TT... | F................. | .V........F....... | ...... | ........... | ............ | 0.04 | 4 |
| E.... | F......G..NQ.N.D.K | ...TE.....F......T | E..KD. | ..TG.A...GN | A..A........ | 0.04 | 4 |
| HT... | F.....AA.HP.P.Q.K | .QPN......F......T | ...N.. | E.TS.D..AFDQ | A..A........ | 0.03 | 3 |
| SA... | .................. | .KD.E....DF....... | R..A.. | ........... | A..A........ | 0.03 | 3 |
| AA... | F.....A.G..V.T.H.R | .KDDG....NF......T | ...... | ENGD....E.DR | A..A........ | 0.03 | 3 |
| RA... | F.....NGT.IL.T.A.K | .Q.S......F....... | R...D. | .SANESD...DQ | A..A........ | 0.03 | 3 |
| SA... | .................. | .................. | E..AD. | E.ASTND..... | A..A........ | 0.03 | 3 |
| ..... | .................. | .................. | ...D.. | ESGS.S.IA.DQ | A..A........ | 0.03 | 3 |
| ..... | F................. | .V........F....... | ...... | ........... | G.RSG..NQA.H | 0.03 | 3 |
| NA... | F.....A.G..V.T.H.R | .QPSR.....F....... | E..NG. | ..AGTSDIA.DR | A..A........ | 0.03 | 3 |
| .A..T | .................. | .................. | E..KD. | .S.ST...E.GH | A..A........ | 0.03 | 3 |
| D...T | .............K.S | .................. | ...... | E.AAGND.EFDQ | ............ | 0.03 | 3 |
| ..... | .................. | .KAS.....NF......T | ....D. | ENG.AG...V.H | A..A........ | 0.03 | 3 |
| ..... | .................. | .................. | R..AD. | ..AAAN..E.DG | A..A........ | 0.03 | 3 |
| GA... | F.....SGA..K.N.S.S | ..A......DF....... | ...DG. | E........... | A..A........ | 0.03 | 3 |
| ..... | F................. | .V........F....... | ...... | ........... | SERTP..F.T.Q | 0.03 | 3 |
| R...T | .................. | TQDGE....DF....... | ...DG. | ENTATDD...GH | A..A........ | 0.03 | 3 |
| RA..T | F.....NQG.RV.I.N.R | .........NF....... | R...D. | .DASGDD.EVD. | A..A........ | 0.03 | 3 |
| ...A. | .................. | .PANG.....F......T | ....GR | .DAS.N...VDG | A..A........ | 0.03 | 3 |
| S.... | F.....AGG.P..L...G | ..A......DF....... | ...ND. | ..GAAND....H | A..A........ | 0.03 | 3 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| AT..T | ................. | .KDDG....NF......T | ...DDR | E.AGRN.T..DD | A..A........ | 0.03 | 3 |
| ..... | ................. | ................. | R..AD. | E.AGGS..AVDG | A..A........ | 0.03 | 3 |
| RA... | ......KT.NK...A.G | .V.......F....... | ...... | ............ | ASSNH..AKG.D | 0.03 | 3 |
| DA... | ..............S.. | .QPG.....NF....... | ...DDR | ED.G.GD.AYDR | A..A........ | 0.03 | 3 |
| ..... | ................. | ................. | R..AGR | .DAG.A.I..DG | A..A........ | 0.03 | 3 |
| ..... | F................ | .V.......F....... | ...... | ............ | GPSSA..IQK.H | 0.03 | 3 |
| D.... | F.....AGT.PK.L.D.S | .KYT.....NF......T | ...... | ............ | A..A........ | 0.03 | 3 |
| ..... | F................ | .V.......F....... | ...... | ............ | ATKTP..SDA.E | 0.03 | 3 |
| SA... | F.....DNT.SK.L...K | TKAGE....NF......T | R...G. | .SG..ND...DG | A..A........ | 0.03 | 3 |
| ..... | F................ | .V.......F....... | ...... | ............ | GTRSP..S.N.D | 0.03 | 3 |
| N...T | ......SRT..A...T.N | ..DGE....DF....... | ...... | ............ | A..A........ | 0.03 | 3 |
| TA..T | F.....DH..R..P.G.S | .V........F....... | ...... | EN.G.A....GQ | A..A........ | 0.03 | 3 |
| ..... | ................. | ................. | ...... | ..GGESD.E.D. | A..A........ | 0.03 | 3 |
| E.... | F.....ASA.S..T.T.G | ................. | E..TD. | ............ | ............ | 0.03 | 3 |
| ..... | F................ | .V.......F....... | ...... | ............ | DRRTE..SRV.A | 0.03 | 3 |
| ..... | ................. | ................. | ...DDR | ...GTND.AYDE | A..A........ | 0.03 | 3 |
| ..... | F................ | .V.......F....... | ...... | ............ | AAHDG...RE.. | 0.03 | 3 |
| ..... | ................. | ................. | ...DDR | E.T..S..A..R | A..A........ | 0.03 | 3 |
| EA... | ................. | ................. | E..AD. | ............ | ............ | 0.03 | 3 |
| ..... | ................. | TQ..H....NF....... | ...... | ..AG.DDIA.DN | A..A........ | 0.03 | 3 |
| N.... | ................. | .KDDG....NF......T | G..DD. | ...NG....VDG | A..A........ | 0.03 | 3 |
| T.... | F.......G.PE.T.G.R | .Q.GQ....DF....... | ....G. | ............ | A..A........ | 0.03 | 3 |
| TT..T | F.....ASA.S..T.T.G | .QPG.....DF....... | ...... | ............ | ............ | 0.03 | 3 |
| ..... | ................. | ................. | ...... | ..TG.N.IAF.D | A..A........ | 0.03 | 3 |
| ..... | ................. | ................. | ...... | ...G.GD.A.DR | A..A........ | 0.03 | 3 |
| NA... | F.....STA..Q.H.Q.L | TK.NE....DF....... | ...... | .N.AE...E.DG | A..A........ | 0.03 | 3 |
| HT..T | F......GT.NM.L.Q.G | .KYT.....NF......T | R...D. | E.GAGSD.E.D. | A..A........ | 0.03 | 3 |
| E.... | F................ | .V.......F....... | ...... | ............ | ............ | 0.03 | 3 |
| RA... | F.....DTG.SM.K.G.M | .Q.S......F....... | ...D.. | ............ | A..A........ | 0.03 | 3 |
| ..... | ................. | ................. | ...N.. | .DAGRN.IA.D. | A..A........ | 0.03 | 3 |
| ..... | ................. | ................. | ...... | ENAS.G.A.VDS | A..A........ | 0.03 | 3 |
| AA... | F......S..PM.T.S.K | .PPNG.....F......T | ...DDR | .D.GG.....GH | A..A........ | 0.03 | 3 |
| ..... | ................. | ................. | ...D.. | ENTSEG....GH | A..A........ | 0.03 | 3 |
| E.... | F.....ASA.S..T.T.G | .QPG.....DF....... | R..DD. | ............ | A..A........ | 0.03 | 3 |
| NT... | F.....AGA.NK.L...K | .V.......F....... | ...... | ENARASDA..GS | A..A........ | 0.03 | 3 |
| TT..T | ................. | TKDDR....DF....... | ...DDR | ............ | A..A........ | 0.03 | 3 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F................ | .V........F....... | ...... | ........... | GRHS....K..E | 0.03 | 3 |
| AT..T | F.....S.A.IA.M.T.R | TQ.TG....DF....... | ...DDR | ..TR.ND.A.DE | A..A........ | 0.03 | 3 |
| G.... | F.....G.G.RA.N.E.R | .KYT.....NF......T | ...DD. | ........... | A..A........ | 0.03 | 3 |
| NA... | ................ | TQADR....NF......T | G..ND. | ........... | A..A........ | 0.03 | 3 |
| ..... | ................ | TKHGG....DF....... | ...DD. | .D.R....AFDD | A..A........ | 0.03 | 3 |
| E.... | F......TG.IL...T.R | .QAS......F....... | ....D. | ........... | A..A........ | 0.03 | 3 |
| ..... | ................ | ..DGE....DF....... | ...... | ..T.EG.IE..H | A..A........ | 0.03 | 3 |
| ..... | ................ | ................ | .....R | ..GSA..I..GG | A..A........ | 0.03 | 3 |
| ..... | ................ | .........DF....... | ...D.. | ........... | A..A........ | 0.03 | 3 |
| ..... | ................ | ................ | ....D. | E.TVTNDA...S | A..A........ | 0.03 | 3 |
| AA... | F................ | TQ.TG....DF....... | ...DDR | E.AGR..A.FDR | A..A........ | 0.03 | 3 |
| ..... | F................ | .V........F....... | ...... | ........... | TPRGG...TM.H | 0.03 | 3 |
| DT... | F.....AQ...A.L.... | ................ | ...... | E.AS.A.TAV.H | A..A........ | 0.03 | 3 |
| ..... | ................ | ................ | ...D.. | E..TRSD.AFDD | A..A........ | 0.03 | 3 |
| N.... | ................ | T.ASH....DF....... | ...DG. | ........... | A..A........ | 0.03 | 3 |
| ..... | ................ | ...........F....... | ...... | E..AGADIE..H | A..A........ | 0.03 | 3 |
| R.... | ................ | .QAS.....NF......T | E..AGR | ........... | A..A........ | 0.03 | 3 |
| ..... | F................ | .V........F....... | ...... | ........... | KDRTP..FQA.D | 0.03 | 3 |
| ..... | F................ | .V........F....... | ...... | ........... | KDHT...S.A.A | 0.03 | 3 |
| SA... | ................ | ................ | G..ND. | ........... | A..A........ | 0.03 | 3 |
| E.... | F.....GAA.L..L.N.S | ................ | ...... | ........... | A..A........ | 0.03 | 3 |
| TA... | F.....GRG.NV.N.S.R | ..YN......F......T | R...G. | ........... | A..A........ | 0.03 | 3 |
| ..... | ................ | ................ | R..DD. | E..G.S.T.FDS | A..A........ | 0.03 | 3 |
| ..... | ................ | ..HG.....NF......T | ...A.. | E.TATDD...DG | A..A........ | 0.03 | 3 |
| ..... | ................ | ................ | E..AD. | E.AKEN.A..DE | A..A........ | 0.03 | 3 |
| EA... | F.....AST.HD.T.E.R | .PPNG.....F......T | ...DDR | ..TG.N.IAF.D | A..A........ | 0.03 | 3 |
| ..... | ................ | ................ | ...... | E.TR.N.....Q | A..A....V... | 0.03 | 3 |
| .A... | F.....ANG.HL.K.K.S | ..A......DF....... | ...DG. | E.AG.GD.EY.. | A..A........ | 0.03 | 3 |
| ..... | F.....DAA.IK.T.Q.N | ..DGE....DF....... | ...... | E.......... | ........... | 0.03 | 3 |
| ..... | ................ | ..P.E....NF....... | R...D. | ESAT.A.A..DR | A..A........ | 0.03 | 3 |
| G.... | F.....NN..SA.N...R | ..DGE....DF....... | ...DDR | .DAG.A.I..DG | A..A........ | 0.03 | 3 |
| G.... | F.......G.PE.T.G.R | .Q.GQ....DF....... | ....G. | ........... | A..A........ | 0.03 | 3 |
| ..... | ................ | ................ | R...D. | EDGSR.D.AV.E | A..A........ | 0.03 | 3 |
| ..... | F.....DAT..L.I.N.R | .KDSR....DF....... | ...D.. | ........... | A..A........ | 0.03 | 3 |
| AT... | F.....SA..RA.....R | .QAS......F....... | ...... | ESAAASD..VGQ | A..A........ | 0.03 | 3 |
| G.... | ................ | .Q.DR.....F....... | ....D. | ...GAD.IA..G | A..A........ | 0.03 | 3 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| NT..T | ................. | ................. | E..AGR | ESAT.A.A..DR | A..A........ | 0.03 | 3 |
| TA..T | F.....GDG....K.Q.R | .V........F....... | ...DDR | .SAKAA.AA.DE | A..A........ | 0.03 | 3 |
| RA..T | F.....GNG.HV.H.G.R | ..ATR....DF....... | ...... | EDADG.DT...H | A..A........ | 0.03 | 3 |
| R...T | ................. | .V........F....... | E..TD. | ............ | A..A........ | 0.03 | 3 |
| E.... | F.....DGT.SM.N.G.R | ..DGE....DF....... | ...... | ............ | A..A........ | 0.03 | 3 |
| GT... | F.....AEG.LK.M.H.L | ..DGE.....F....... | ...... | ............ | A..A........ | 0.03 | 3 |
| H.... | F.....GQG.IA.....K | .Q.......DF....... | G..DG. | ............ | A..A........ | 0.03 | 3 |
| GA... | ................. | T.ASH....DF....... | ...DDR | ..AG.A..EFGG | A..A........ | 0.03 | 3 |
| G...T | F.....DAT..L.I.N.R | T.P......DF....... | ...D.. | ...TTSD..F.H | A..A........ | 0.03 | 3 |
| D.... | F................. | .V........F....... | ...... | ............ | TAQSG..FN..D | 0.03 | 3 |
| ..... | F................. | .V........F....... | ...... | ............ | S.SNG...GG.T | 0.03 | 3 |
| A.... | ................. | ..DGE....DF....... | R...GR | ENTSRND.EV.S | ............ | 0.03 | 3 |
| ..... | F.....GK..SI.N.K.R | ................. | ...DDR | ............ | A..A........ | 0.03 | 3 |
| ..... | F................. | .Q.DH....NF....... | ...DD. | ............ | A..A........ | 0.03 | 3 |
| ..... | ................. | .................T | R..AG. | ............ | A..A........ | 0.03 | 3 |
| D.... | F.....NKT.I..K.... | .Q.DR.....F....... | G..ND. | ............ | A..A........ | 0.03 | 3 |
| ..... | ................. | ................. | E..AD. | .DTGGNDAE.DQ | A..A........ | 0.03 | 3 |
| ..... | ................. | ................. | E..NGR | .NGDTSD.A..Q | A..A........ | 0.03 | 3 |
| G.... | ................. | ........NF....... | R...D. | EN.G.G..EF.Q | A..A........ | 0.03 | 3 |
| SA... | ................. | .QAS......F....... | ...... | E.ATRGDTE.DR | A..A........ | 0.03 | 3 |
| ..... | ................. | ................. | G..DD. | ES.DRN..A.DN | A..A........ | 0.03 | 3 |
| ..... | ................. | ................. | ...DDR | E.AGAND.AV.H | A..A........ | 0.03 | 3 |
| ..... | ................. | ................. | ...... | E.ATADDA..GS | A..A........ | 0.03 | 3 |
| D...T | F.....NDG.PA.K.T.R | .QHNQ.....F......T | ...N.. | E.TGAN.AE.GE | A..A........ | 0.03 | 3 |
| DT... | F.....AEG.LK.M.H.L | ..DGE....DF....... | ...... | ............ | ............ | 0.03 | 3 |
| GT... | F................. | .V........F....... | ...... | ............ | ............ | 0.03 | 3 |
| ..... | ................. | ................. | R..DD. | .DTG.GD.A..H | A..A........ | 0.03 | 3 |
| ..... | F................. | .V........F....... | ...... | ............ | TTSA...VRV.D | 0.03 | 3 |
| ..... | ................. | ................. | ...DD. | .DAGES..AF.Q | A..A........ | 0.03 | 3 |
| ..... | ................. | ........NF......T | R...D. | ENGREND.A.DD | A..A........ | 0.03 | 3 |
| ..... | F................. | .V........F....... | ...... | ............ | NNQGR..YTG.E | 0.03 | 3 |
| ..... | ................. | ................. | ...AG. | ............ | A..A........ | 0.03 | 3 |
| ..... | ................. | .................T | ...AG. | ..ASE...E.DN | A..A........ | 0.03 | 3 |
| ..... | ................. | ................. | ...D.. | ESAKTADAAVDD | A..A........ | 0.03 | 3 |
| ..... | F.....SN..PL.K.T.. | ................. | G..A.R | E.AG..D.A.GR | A..A........ | 0.03 | 3 |
| NA... | F.....DR..II...A.R | ................. | ...AG. | E.AGGD.AA.DD | A..A........ | 0.03 | 3 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| DT... | F.....DHT.R..M.G.R | .Q.T.....NF.......T | R...DD. | ........... | A...A........ | 0.03 | 3 |
| R.... | F.....SGA..N...G.R | .Q.DH....NF....... | ...DD. | .NAA.A...GD | A...A........ | 0.03 | 3 |
| E.... | F.....S.T.NV.L.D.. | .Q.DR.....F....... | ...DGR | E.ATG...A.G. | A...A........ | 0.03 | 3 |
| ..... | ................. | TQ.TQ.....F....... | ...DDR | ........... | A...A........ | 0.03 | 3 |
| ..... | ................. | ................. | ...N.. | ..TR.ND.A.D. | A...A........ | 0.03 | 3 |
| N.... | ................. | ..AGR....DF......T | R...D.. | ES.TTG..A..G | A...A........ | 0.03 | 3 |
| N.... | ......DAT..Q.L.G.. | .KDT......F......T | ...D.R | ........... | ............ | 0.03 | 3 |
| ..... | ................. | ....H............ | R...DD. | EDGAAA....GQ | A...A........ | 0.03 | 3 |
| .A..T | F.....GRT.ND.L.Q.R | .........NF....... | R...D. | E.TR.N.....Q | A...A........ | 0.03 | 3 |
| ..... | ................. | .........DF....... | ....D. | ESAN...I...H | A...A........ | 0.03 | 3 |
| N.... | F.....AE...A.T...R | ..PN.....NF....... | ...... | ES.TRSDI.FDH | A...A........ | 0.03 | 3 |
| TT..T | F.....AQG.NV.H.K.R | ................. | ...... | .NGSAN..E.DQ | A...A........ | 0.03 | 3 |
| ..... | F.....DA..IA.L.K.R | .KDSR....DF......T | G...DG. | ........... | ............ | 0.03 | 3 |
| ..... | F................ | .V........F....... | ...... | ........... | SHRGE..FDV.T | 0.03 | 3 |
| E.... | F......AG.NV.N.S.R | T.P......DF....... | ...DG. | E.TDGNDA..GQ | A...A........ | 0.03 | 3 |
| E.... | ......SG..IK.K.D.R | .KPDQ....DF....... | ...D.. | ........... | ............ | 0.03 | 3 |
| GA... | F.....DG..I..K.K.G | .QAS......F....... | ...... | .SAKAA.AA.DE | A...A........ | 0.03 | 3 |
| .A... | F.....DQ..R..P.S.R | T.PGG....NF....... | ...D.R | ........... | A...A........ | 0.03 | 3 |
| D.... | F.....AQA.IK.M.A.S | .QPN......F......T | ...N.. | ........... | A...A........ | 0.03 | 3 |
| H.... | ................. | ................. | ...DDR | ENGD....E.DR | A...A........ | 0.03 | 3 |
| ..... | ................. | .V.......DF....... | ...... | ........... | A...A........ | 0.03 | 3 |
| ..... | ................. | ................. | E..NGR | ........... | A...A........ | 0.03 | 3 |
| ..... | ................. | .QDT......F......T | ...D.. | ........... | A...A........ | 0.03 | 3 |
| RA... | F................ | .V........F....... | ...... | ........... | APRNS..VR..H | 0.03 | 3 |
| ..... | ................. | ................. | ...... | E.TKRA.AEVDQ | A...A........ | 0.03 | 3 |
| TA... | F................ | ................. | ...... | ........... | GQRDG...RN.A | 0.03 | 3 |
| ..... | ................. | ................T | ...NDR | E.TGAN.AE.GE | A...A........ | 0.03 | 3 |
| ..... | F................ | .V.......F....... | ...... | ........... | TRHSP..SEG.H | 0.03 | 3 |
| ..... | F.....GTG..P.T.D.R | .KYT.....NF......T | ....D. | ........... | A...A........ | 0.03 | 3 |
| GT... | F................ | .V.......F....... | ....G. | ........... | A...A........ | 0.03 | 3 |
| GT..T | ................. | ................. | ...... | ........... | ............ | 0.03 | 3 |
| ..... | ................. | ................T | R..N.. | ........... | A...A........ | 0.03 | 3 |
| TT..T | F.....NAT.RP.K.A.R | .V........F....... | ...... | ..AGT.D.EYGQ | A...A........ | 0.03 | 3 |
| ..... | ................. | ................. | E..KG. | ........... | A...A........ | 0.03 | 3 |
| ..... | ................. | ................. | ...D.R | E.ADRN....GS | A...A........ | 0.03 | 3 |
| R.... | F.....GRG.NQ.K.E.H | T.P......DF....... | ...D.. | KNARASDAAVDQ | A...A........ | 0.03 | 3 |

TABLE 3-continued

AAV capsid proteins having increased specificity for and/or transduction of CD447$^-$/133$^-$ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| G.... | F.....NQG.RV.I.N.R | ..DGE....DF....... | ...... | ........... | A..A........ | 0.03 | 3 |
| ..... | F.....SGA..K.N.S.S | TQDS.....NF....... | ...... | E.AAAA..AF.S | A..A........ | 0.03 | 3 |
| RA..T | F................. | .V.........F...... | ...... | ........... | APRNS..VR..H | 0.03 | 3 |
| GA... | .................. | ..PNG....DF....... | G..NDR | ..TGTS...YDS | A..A........ | 0.03 | 3 |
| .T..T | F.....GN..HM.P.... | TQASG.....F......T | ...D.. | ........... | A..A........ | 0.03 | 3 |
| D...T | F......Q...Q.L.K.V | ..DGE....DF....... | ...... | ........... | A..A........ | 0.03 | 3 |
| RA... | .................. | .................. | E..TG. | .NAA...A..DD | A..A........ | 0.03 | 3 |
| ..... | .................. | ..A.Q....NF....... | ...DD | E.AG.GD.EY.. | A..A........ | 0.03 | 3 |
| RA... | .................. | ..YN......F......T | ...D.R | ........... | A..A........ | 0.03 | 3 |
| ..... | F................. | .V.........F...... | ...... | ........... | AASS....RV.. | 0.03 | 3 |
| NT... | F.....NR..N..I.T.G | TKPS.....DF....... | ...DDR | ........... | A..A........ | 0.03 | 3 |
| TA..T | F.....GR..PN.N.Q.L | .KP......NF....... | R..ND. | ENTN.ADAA..E | A..A........ | 0.03 | 3 |
| E.... | F.....DTT.SH.T.T.G | T.P......DF....... | ...D.. | ..AARS..AF.Q | ............ | 0.03 | 3 |
| AT... | F.....AST.PI.K.Q.K | TQ.TH....DF....... | ...... | ........... | A..A........ | 0.03 | 3 |
| NT... | .................. | ..........F......T | R..AG. | E.ASGG.A..GS | V..A........ | 0.03 | 3 |
| SA..T | F.....DGT.SM.N.G.R | ..DD.....DF....... | ....D. | ........... | ............ | 0.03 | 3 |
| ..... | F................. | .V.........F...... | ...... | ........... | GRQDS..NR..E | 0.03 | 3 |
| ..... | .................. | .................. | R..DD. | EN.KAN....GG | A..A........ | 0.03 | 3 |
| ..... | .................. | ..DGE....DF....... | R..DD. | ........... | A..A........ | 0.03 | 3 |
| ..... | .................. | .................. | ...D.. | ESGGTD....DR | A..A........ | 0.03 | 3 |
| A.... | .................. | .................. | R..N.. | ........... | ............ | 0.03 | 3 |
| T.... | F......AG..L.T.N.R | .................. | ...... | ........... | A..A........ | 0.03 | 3 |
| ..... | F................. | .V.........F...... | ...DDR | ........... | NSRAT..S.G.H | 0.03 | 3 |
| GA... | F.....GHA.I..K.H.H | ..DGE....DF....... | ...... | ........... | A..A........ | 0.03 | 3 |
| ..... | F................. | .V.........F...... | ...... | ........... | GESG...AEM.T | 0.03 | 3 |
| ..... | .................. | .................. | R..D.R | ..AGEN..A.GN | A..A........ | 0.03 | 3 |
| ..... | .................. | ........DF......T | ...AG. | .NATG....VGS | A..A........ | 0.03 | 3 |
| ..... | ......STG.LH.T...R | ..DT.....KF......T | ...... | .NGSAN..AFGQ | A..A........ | 0.03 | 3 |
| ..... | .................. | .................. | ...DDR | E.AS.N..E.GQ | A..A........ | 0.03 | 3 |
| TA... | F................. | .................. | R...D. | ........... | ............ | 0.03 | 3 |
| NA..T | F.....SS..SL.K.E.K | .................. | ...... | .DARAADA...Q | A..A........ | 0.03 | 3 |
| ..... | F......AG.NP.P.D.R | .QAS.....NF....... | ...... | ........... | A..A........ | 0.03 | 3 |
| ..... | .................. | .................. | G..AGR | ........... | A..A........ | 0.03 | 3 |
| ..... | F.....NKT.IV.T.E.R | .........NF....... | R...D. | ........... | A..A........ | 0.03 | 3 |
| D.... | F.....SR...V.T.N.V | .I................ | ...... | E.TA.G.....G | A..A........ | 0.03 | 3 |
| ..... | F.....GR..IN...A.R | ..DGE....DF....... | E..AGR | ........... | A..A........ | 0.03 | 3 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| TA..T | F.......G.HK.T.N.G | T.PTG....DF....... | ...DDR | ..AG.N.AA.GQ | A..A........ | 0.03 | 3 |
| ..... | F................. | .V.........F....... | ...... | ............ | SPKN...AGS.H | 0.03 | 3 |
| E.... | F.....AQ...A.L.... | .................. | ...... | ............ | A..A........ | 0.03 | 3 |
| DA... | .................. | ..ATR....DF....... | ...... | ...GAD.IA..G | A..A........ | 0.03 | 3 |
| ..... | F.....GG..NK.M.... | .................. | ...D.R | ............ | A..A........ | 0.03 | 3 |
| ..... | F.....SNG.RE.L...K | TQ.TG....NF....... | ...... | .N.AGNDAAVDE | A..A........ | 0.03 | 3 |
| ..... | .................. | .V.........F....... | ...... | E.GT.G.T..GH | A..A........ | 0.03 | 3 |
| G...T | F.....AHG.HL.T.P.R | ...TE.....F......T | ...NGR | ..ANRD.A..DQ | A..A........ | 0.03 | 3 |
| ..... | F.....SRT..A...T.N | ..A.R....DF....... | R...D. | ............ | A.HAD........ | 0.03 | 3 |
| D...T | F.....NGG.NV.N.K.G | ..DNH....NF....... | R...G. | ............ | A..A........ | 0.03 | 3 |
| SA... | F......RT.LA.L.G.K | ..DGE....DF....... | R..DD. | E.AAND.EYGH | A..A........ | 0.03 | 3 |
| ..... | .................. | .................. | ...... | .NAGEG...VDS | A..A........ | 0.03 | 3 |
| ..... | .................. | .KPDQ....DF....... | R...DR | ............ | .SARGA.A.YDD | 0.03 | 3 |
| ..... | .................. | .................. | ...... | .DGGRG.AA..Q | A..A........ | 0.03 | 3 |
| ..... | ......ATT.NV.T.K.S | .Q.......DF....... | ...AD. | ............ | A..A........ | 0.03 | 3 |
| ..... | .................. | .................. | R..AGR | ............ | A..A........ | 0.03 | 3 |
| RA... | .................. | .................. | ...... | ............ | ............ | 0.03 | 3 |
| ..... | .................. | ..YN......F......T | ...... | ..ARTADTE.DS | A..A........ | 0.03 | 3 |
| ..... | F.....GG..NK.M.... | ..DGE....DF....... | ...... | .DAGRN.IA.DG | A..A........ | 0.03 | 3 |
| ..... | .................. | .................. | ...... | ESGRANDA...S | A..A........ | 0.03 | 3 |
| ..... | .................. | .................. | ...DG. | ..ASE..AAYDS | A..A........ | 0.03 | 3 |
| ..... | .................. | .................. | ....D. | ..TD.N...VGQ | A..A........ | 0.03 | 3 |
| .A... | .................. | ..HG.....NF......T | ...A.. | ............ | A..A........ | 0.03 | 3 |
| ..... | F................. | .V.........F....... | ...... | ............ | GPRGP..DGE.H | 0.03 | 3 |
| ..... | .................. | .................. | ...... | .NTGTA..E... | A..A........ | 0.03 | 3 |
| A.... | F.....GKG.ND.T.N.R | .V.........F....... | ...... | ENGGTN..E.GN | A..A........ | 0.03 | 3 |
| ..... | F................. | .V.........F....... | R..DGR | ENGGGSDAE.DD | A..A........ | 0.03 | 3 |
| ..... | .................. | .................. | ...DDR | ..ARGADAE..S | A..A........ | 0.03 | 3 |
| ..... | F......GT.NM.L.Q.G | .Q.S.............. | ...DDR | ............ | ............ | 0.03 | 3 |
| H.... | .................. | .Q.GQ....DF....... | ..G. | .NGST.....GG | A..A........ | 0.03 | 3 |
| E.... | F.....SA..SI.M.G.R | .QPN.....DF....... | ...D.. | ..TGTS...YGS | A..A........ | 0.03 | 3 |
| ..... | .................. | ........NF....... | ....D. | E.ARAN.IEVDQ | A..A........ | 0.03 | 3 |
| RA..T | .................. | TKHGG....NF......T | R...D. | ............ | A..A........ | 0.03 | 3 |
| ..... | F....DAT.NL.H.Q.L | .........F......T | ...DG. | ............ | ............ | 0.03 | 3 |
| ..... | .................. | .........DF.....T | ....D. | .DGSGD.IA.DG | A..A........ | 0.03 | 3 |
| ..... | F................. | .V.........F....... | ...... | ............ | GAHAD..FHV.D | 0.03 | 3 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| G...T | ................. | .Q.S......F....... | E..N.. | ........... | ........... | 0.03 | 3 |
| A...T | ................. | .K.TG....DF....... | R...DR | ........... | A..A........ | 0.03 | 3 |
| TA... | F................ | ................. | ...NDR | | | 0.03 | 3 |
| D.... | F.....GRG.H..P.E.R | .V........F....... | ...... | ENGREG.AA..H | A..A........ | 0.03 | 3 |
| .A... | F.....ATG.NV.T.G.R | .Q.DR.....F....... | ....D. | | GQKDR..ST..H | 0.03 | 3 |
| E.... | ................. | .QPSR.....F......T | ...D.. | .DAG.S.A..DR | A..A........ | 0.03 | 3 |
| R.... | ................. | ..........F....... | R..AD. | .NAR.A.I..GE | A..A........ | 0.03 | 3 |
| ..... | ................. | ................. | ...DD. | E.TR.N.....Q | A..A........ | 0.03 | 3 |
| AA... | ................. | TQP.R....NF......T | R...D. | ..A.G...AYD. | A..A........ | 0.03 | 3 |
| RT... | F.....AT..LV.L.... | ..DGE....DF....... | ...... | | | 0.03 | 3 |
| DT... | F.....NQG.HK.P.N.G | .........NF....... | R...D. | | A..A........ | 0.03 | 3 |
| R...T | F.....DHT.R..M.G.R | TQ.TQ....F....... | R..A.. | E.ARGN.I..DE | A..A........ | 0.03 | 3 |
| ..... | ................. | ................. | R...GR | | A..A........ | 0.03 | 3 |
| RA... | ................. | ................. | ...AG. | | | 0.03 | 3 |
| ..... | ................. | ................. | R...D. | E.AGG.DI..GH | A..A........ | 0.03 | 3 |
| ..... | ................. | .........NF....... | ....G. | ESTARN.A.V.Q | A..A........ | 0.03 | 3 |
| ..... | F.....DA..IA.L.K.R | ................. | R...G. | ESGGE.....GG | A..A........ | 0.03 | 3 |
| GT... | ................. | .........NF......T | E..DD. | | | 0.03 | 3 |
| ..... | F................ | .V........F....... | ...... | | ARQNGP.A.T.E | 0.03 | 3 |
| ..... | F................ | .V........F....... | ...... | | NPKTA..AHS.E | 0.03 | 3 |
| TT..T | F.....SGT.MM.K.T.E | .Q.GQ....DF....... | ....G. | | A..A........ | 0.03 | 3 |
| ..... | ................. | ................. | E..NG. | .DTSGA.I.VDQ | A..A........ | 0.03 | 3 |
| ..... | F................ | .V........F....... | ...... | | .DRST..VQG.H | 0.03 | 3 |
| G.... | F.......T.SV...H.R | ................. | ...... | | A..A........ | 0.03 | 3 |
| ..... | ................. | .QDT......F......T | ...T.R | | A..A........ | 0.03 | 3 |
| ..... | ................. | .V........F....... | ...... | | GASSN..ATV.E | 0.03 | 3 |
| ..... | F................ | .V........F....... | ...... | | GRQSG..SR..P | 0.03 | 3 |
| ..... | ................. | ................. | ...N.. | ENAGGD..E..R | A..A........ | 0.03 | 3 |
| ..... | ................. | ................. | ....D. | ESAKTADAAVDD | A..A........ | 0.03 | 3 |
| ..... | ................. | ................. | R..AD. | | A..A........ | 0.03 | 3 |
| RA... | ................. | ................. | R..DG. | | A..A........ | 0.03 | 3 |
| ..... | ................. | ................. | E..NGR | ..AG.DD...GG | A..A........ | 0.03 | 3 |
| ..... | ................. | ................. | ...DDR | .NGST.....GG | A..A........ | 0.03 | 3 |
| RA... | F.....NGT.L..M.K.R | ..HTG....DF....... | ...D.R | | A..A........ | 0.03 | 3 |
| G.... | F.....A...H......L | .QD.E.....F..P.... | ...DDR | | A..A........ | 0.03 | 3 |
| D...T | F.....SN..PL.K.T.. | ..HG.....NF......T | ...DDR | | A..A........ | 0.03 | 3 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| H.... | F.....AR..IE.I.G.R | T.PDH....DF......T | R...G. | ..ATTDD..VDG | A..A........ | 0.03 | 3 |
| ..... | ................. | ................. | ...N.. | E.AARS...Y.H | A..A........ | 0.03 | 3 |
| ..... | F.....DT..NI.K.S.M | .QHTH....NF......T | ...ADR | ..AST..AA..D | A..A........ | 0.03 | 3 |
| TA... | F.....AGA.HK.N.G.G | .........NF....... | R...D. | ............ | A..A........ | 0.03 | 3 |
| D...T | F......GT.NM.L.Q.G | TQP.R.....F....... | ....D. | ............ | ............ | 0.03 | 3 |
| D.... | F.....ATG.NN.I.S.G | .PPN......F....... | R..A.. | .NAGASDA.FDQ | A..A........ | 0.03 | 3 |
| ..... | ................. | ................. | ...DG. | E.AGAND.AV.H | A..A........ | 0.03 | 3 |
| ..... | F................. | ................. | R...D. | EDAGAA..EFGQ | A..A........ | 0.03 | 3 |
| ..... | F................. | .V........F....... | ...... | ............ | KDRAA..VHN.H | 0.03 | 3 |
| TA... | F.....GNT.RP.T.S.M | .Q.GQ....DF....... | ....D. | E.AAAN..E.DG | A..A........ | 0.03 | 3 |
| ..... | ................. | ................. | ...AG. | E.AAAN..E.DG | A..A........ | 0.03 | 3 |
| E.... | ................. | .........DF....... | ...DDR | ............ | ............ | 0.03 | 3 |
| DT... | F.....ANG.HL.K.K.S | ..A......DF....... | ...DG. | E.AG.GD.EY.. | A..A........ | 0.03 | 3 |
| ..... | ................. | ................. | ...DG. | E........... | A..A........ | 0.03 | 3 |
| AT... | F.....SG..IK.K.D.R | T.P......DF....... | ....D. | .DAG.A.I..DG | A..A........ | 0.03 | 3 |
| ..... | ................. | ................. | R..DG. | E.ASTA..A.GQ | A..A........ | 0.03 | 3 |
| G.... | F.....AG..RV.T.G.S | ..DGE....DF....... | ...... | EDAG...I..GQ | A..A........ | 0.03 | 3 |
| ..... | ................. | ..DGE....DF....... | R...D. | EN.GT..AA.GD | A..A........ | 0.03 | 3 |
| RA... | F.....NGG.NI.K.E.R | T.PGG....NF....... | R..DD. | ............ | A..A........ | 0.03 | 3 |
| ..... | F.....SKA.S..L.E.R | ..A......DF....... | ...DG. | ............ | A..A........ | 0.03 | 3 |
| GT... | ................. | ................. | ...... | ............ | ............ | 0.03 | 3 |
| ..... | ................. | ................. | ...DDR | ..AK.ADT..GN | A..A........ | 0.03 | 3 |
| A.... | F.....AT..PM.L.... | T.P......DF....... | ...D.. | ............ | ............ | 0.03 | 3 |
| ..... | F................. | .V........F....... | ...... | ............ | SHRTA..STA.A | 0.03 | 3 |
| ..... | F.....SD..I..H.D.R | ................. | ...... | ............ | A..A........ | 0.03 | 3 |
| ..... | F.....SD..HP.L.Q.K | .........NF....... | R...D. | ENAAA.D..FGH | A..A........ | 0.03 | 3 |
| ....T | ................. | ..AGR....DF......T | ....D. | ............ | A..A........ | 0.03 | 3 |
| ..... | ......ASA.SV.H.T.G | .V........F....... | ...... | E.AAGA.IA.GE | A..A........ | 0.03 | 3 |
| GA... | F.....AST.IN.L.T.. | .Q.......DF....... | ...DDR | ...GAD.IA..G | A..A....E... | 0.03 | 3 |
| NT... | F.....NET.NA.P...K | ................. | ...... | E.AST.DAAV.Q | A..A........ | 0.03 | 3 |
| A.... | F.....GN..NA.T...M | TQ.TG....DF....... | E..ND. | ............ | A..A........ | 0.03 | 3 |
| ..... | F................. | .V........F....... | ...... | ............ | KEHTR..VN..D | 0.03 | 3 |
| .A... | F.....ATT.L..M...G | .V........F....... | ...DDR | E........... | A..A........ | 0.03 | 3 |
| ..... | ................. | ................. | ...N.. | ...T.N.T...R | A..A........ | 0.03 | 3 |
| ..... | ................. | ................. | ....D. | EDAGAA..EFGQ | A..A........ | 0.03 | 3 |
| ..... | ................. | ................. | ...... | E.GTEGDA..D. | A..A........ | 0.03 | 3 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F................ | .V........F....... | ...... | ............ | GAHAT..VR..T | 0.03 | 3 |
| R.... | F.....NGG.NN.K.T.R | .........NF....... | R...D. | .DTG.GD.A..H | A..A........ | 0.03 | 3 |
| AA... | ................. | .KAS.....NF......T | E..DD. | ............ | A..A........ | 0.03 | 3 |
| ..... | F................ | .V........F....... | ...... | ............ | DQSDS..ITI.H | 0.03 | 3 |
| AT... | F......TG.IL...T.R | .V........F....... | ...DD. | ESTSTA..E... | A..A........ | 0.03 | 3 |
| RT... | F.....DTG.PA.L.T.K | TKAT.....NF....... | ...DD. | E..GGND....R | A..A........ | 0.03 | 3 |
| ..... | F................ | .V........F....... | ...... | ............ | TARNG..VRE.H | 0.03 | 3 |
| NT... | F......AG.L..L.K.G | ................. | ...... | ............ | A..A........ | 0.03 | 3 |
| ..... | ................. | .QAS......F....... | E..NG. | ............ | A..A........ | 0.03 | 3 |
| ..... | ................. | ................. | E..DDR | E.ARAA.I..GQ | A..A........ | 0.03 | 3 |
| A...T | F.....DQ..R..P.S.R | .Q.......DF....... | G..KGR | EDAGT...AFD. | A..A........ | 0.03 | 3 |
| ..... | F.....GGG.NH.T.D.R | TKDT.....NF....... | ...DDR | E.AAASD.EYGE | A..A........ | 0.03 | 3 |
| RA..T | F.....AQG.SN.K.G.K | .........DF....... | ...D.. | ENAATN.AA.DE | A..A........ | 0.03 | 3 |
| R.... | F.....SA..RA.....R | ..DD.....DF....... | ...A. | ............ | A..A........ | 0.03 | 3 |
| DT... | F................ | .Q.DH....NF....... | ...DD. | ............ | A..A........ | 0.03 | 3 |
| ..... | F................ | .V........F....... | ...... | ............ | .PQGE...EE.P | 0.03 | 3 |
| ..... | ................. | .PANG.....F....... | ...DDR | .DAG.A.I..DG | A..A........ | 0.03 | 3 |
| ..... | ................. | ................. | ...DDR | E..TA.D...GR | A..A........ | 0.03 | 3 |
| ..... | ................. | ................. | ...DD. | .DTGRN..E.DS | A..A........ | 0.03 | 3 |
| D.... | F......S.T.NV.L.D. | .Q.DR.....F....... | ...DGR | E.ATG...A.G. | A..A........ | 0.03 | 3 |
| T...T | F.....DS..RA.P.A.S | .QPSQ....DF....... | R...D. | ............ | A..A........ | 0.03 | 3 |
| ..... | ................. | ................. | ...DDR | E.AGRN.T..DD | A..A........ | 0.03 | 3 |
| TA... | F.....GGG.LD.T...R | .Q.S......F....... | E..N.. | ............ | A..A........ | 0.03 | 3 |
| ..... | F................ | .V........F....... | ...... | ............ | DPRGG..VQK.A | 0.03 | 3 |
| ..... | ................. | ................. | ...DDR | ENASGD..EVDS | A..A........ | 0.03 | 3 |
| ..... | F.....GN..NK.P.P.N | .Q.DR.....F....... | ....D. | ..AST..AA..D | A..A........ | 0.03 | 3 |
| ..... | F................ | .V........F....... | ...... | ............ | EARGP..IQK.D | 0.03 | 3 |
| NT..T | F.....GRG.SP.K...G | .........DF....... | ...... | .D.GG.....GH | A..A........ | 0.03 | 3 |
| A.... | F.....GRT.PQ.T.T.R | .Q.DH....NF....... | ...DD. | ENGSGGD.A.DN | A..A........ | 0.03 | 3 |
| .A... | ................. | ................. | E..DD. | ............ | A..A........ | 0.03 | 3 |
| TA... | ................. | .QPN.....F.......T | ...N.. | ..GTAG...V.G | A..A........ | 0.03 | 3 |
| HT... | F.....NTG.HP.T.G.M | T.P.....DF....... | ...D.. | ............ | ............ | 0.03 | 3 |
| NA..T | F.....G.G.HA.T.G.R | ..A.....DF....... | ...DG. | ............ | A..A........ | 0.03 | 3 |
| GA... | F.....SGA..K.N.S.S | ..A.....DF......T | ....D. | ............ | ............ | 0.03 | 3 |
| E.... | F......SG.HP.T.A.L | .KYT.....NF....... | ...D.. | ............ | A..A........ | 0.03 | 3 |
| ..... | ................. | ..HG.....NF....... | E..KD. | ............ | A..A........ | 0.03 | 3 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F.....SK..PA.K.A.G | TQ.TG....DF....... | ...DDR | ..ATRD.T..GH | A..A........ | 0.03 | 3 |
| ..... | F......GA.HP.K...V | .V........F....... | R...G. | E..AAS....GG | A..A........ | 0.03 | 3 |
| ..... | .................. | T.P......DF......T | G..N.. | ED......... | A..A........ | 0.03 | 3 |
| ..... | .................. | .................. | G..D.R | .SGKRA..E.DQ | A..A........ | 0.03 | 3 |
| N...T | F.....NQG..V.L.N.R | TQDGQ.....F....... | ....D. | .......... | A..A........ | 0.03 | 3 |
| RA... | .................. | TQ.TG....NF....... | F...N. | .......... | A..A........ | 0.03 | 3 |
| ..... | F................. | .................. | ...... | .......... | .......... | 0.03 | 3 |
| TA... | F.....NGG.HV.....L | TKDDR....DF....... | ...DDR | .......... | A..A........ | 0.03 | 3 |
| ..... | F.....SA..RA.....R | TKDDR....DF....... | E..AG. | .......... | .......... | 0.03 | 3 |
| ..... | F................. | .V........F....... | ...... | .......... | G.RNG..VTM.Q | 0.03 | 3 |
| AT... | F......QT.P..L.Q.R | ..PN.....NF....... | R...D. | .DGNGA..E..G | A..A........ | 0.03 | 3 |
| ..... | F................. | .V........F....... | ...... | .......... | ATRAP..DTR.D | 0.03 | 3 |
| ..... | F................. | .V........F....... | ...... | .......... | SKKTA..VET.A | 0.03 | 3 |
| ..... | .................. | .V........F....... | E..DD. | .NAA.A....GD | A..A........ | 0.02 | 2 |
| EA... | F.....ATT.NV.T.K.S | .KYT......F......T | ...D. | .......... | A..A........ | 0.02 | 2 |
| HA... | F.....NTG.RN.T.T.R | .................. | ...... | .......... | A..A........ | 0.02 | 2 |
| E.... | F.....ASA.S..T.T.G | RQPG.....DF....... | ...DDR | .......... | .......... | 0.02 | 2 |
| ..... | .................. | .................. | R..DD. | EDAGT...AFD. | A..A........ | 0.02 | 2 |
| ..... | F.....ASA.S..T.T.G | .QPG.....DF....... | ...DDR | EN.GTN.AE.DN | A..A........ | 0.02 | 2 |
| EA... | .................. | .........F......T | ...NGR | .DAG.A.I..DG | A..A........ | 0.02 | 2 |
| ..... | .................. | .................. | ...DG. | E....ND.EF.Q | A..A........ | 0.02 | 2 |
| G.... | F.....GS..NK.M.A.R | ..YN......F......T | ...D.R | .......... | .......... | 0.02 | 2 |
| GT... | F.....GS..NM.N.E.R | ..DGE....DF....... | ...... | .......... | A..A........ | 0.02 | 2 |
| NA..T | F......AG.SH.T.A.R | T.P......DF....... | ...DDR | EDGAA.DAA.DE | A..A........ | 0.02 | 2 |
| ..... | .................. | .................T | V..DD. | .......... | .......... | 0.02 | 2 |
| ..... | ......SR..NE.M...S | .........NF....... | R..AG. | .SAS.N.IA..E | A..A........ | 0.02 | 2 |
| ..... | .................. | T..NE....NF....... | ...DD. | .NAG.D..AFDG | A..A........ | 0.02 | 2 |
| R...T | .................. | .................. | E...KG | .......... | A..A........ | 0.02 | 2 |
| ..... | F.......G.SE.N...R | .................. | ...... | .......... | A..A........ | 0.02 | 2 |
| ..... | F................. | .................. | E..TG. | .......... | .......... | 0.02 | 2 |
| ..... | .................. | .................. | ...DDR | ESAG...TEYD. | A..A........ | 0.02 | 2 |
| TT... | F.....NNA..K...K.. | ..PN.....NF....... | ...NDR | .......... | A..A........ | 0.02 | 2 |
| GT... | F.....GT..NQ.K.G.R | .QHNQ.....F......T | ...N.. | .......... | A..A........ | 0.02 | 2 |
| RA... | F................. | .........NF....... | R...D. | .......... | A..A........ | 0.02 | 2 |
| TA... | F.....GHA.HD.T...I | .Q.S......F....... | ...DDR | ESGSGAD...GR | A..A........ | 0.02 | 2 |
| TT..T | .................. | .................. | G..DG. | .......... | .......... | 0.02 | 2 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ................. | ...AGR | .S.G.S.IA..G | A..A........ | 0.02 | 2 |
| ..... | F......N..IL.T.T.R | .QPSQ....NF....... | G...GR | ........... | A..A........ | 0.02 | 2 |
| D.... | F.....GTG.HN.T.G.R | .PPDR....DF....... | R..DD. | .SASGSD.A.DE | A..A........ | 0.02 | 2 |
| .A... | F.....DHT.R..M.G.R | ................. | ...... | ........... | A..A........ | 0.02 | 2 |
| ..... | ................. | ................. | ....GR | ..TRRD.A.FDG | A..A........ | 0.02 | 2 |
| A...T | F...K..S..PM.T.S.K | ..YN......F......T | ...D.R | ........... | ........... | 0.02 | 2 |
| SA... | F.....NGG.RP...D.G | T..NE....DF....... | ...DDR | ........... | A..A........ | 0.02 | 2 |
| ..... | F................ | .V........F....... | ...... | ........... | ERKGT...R..D | 0.02 | 2 |
| RT... | ................. | TQHNG....NF......T | R..D.. | .DGKGS.IA..G | A..A........ | 0.02 | 2 |
| ..... | F................ | .V........F....... | ...... | ........... | GRAA..FDG..Q | 0.02 | 2 |
| ..... | .........SM.L...R | .........NF....... | R...D. | EDTG.A....GN | A..A........ | 0.02 | 2 |
| E.... | F.....AEG.LK.M.H.L | ..DGE....NF....... | R..D.. | ..GGAND.AV.Q | A..A........ | 0.02 | 2 |
| AA... | ................. | ..PN.....NF....... | ....D. | .DA.EG....GR | A..A........ | 0.02 | 2 |
| ..... | F.....AA...K.T.E.L | ..DGE....DF....... | ...... | ........... | A..A........ | 0.02 | 2 |
| A...T | ................. | T.PGG....NF....... | ....D. | EN.RAG.....E | A..A........ | 0.02 | 2 |
| ..... | ................. | TQDDR....NF......T | ...DDR | ........... | A..A........ | 0.02 | 2 |
| ..... | ................. | .........DF....... | ...D.. | ESGGAN..EYDG | A..A........ | 0.02 | 2 |
| EA..T | ................. | ................. | ....D. | E.ARE...E.DQ | ........... | 0.02 | 2 |
| AT..T | F......KG.NL...Q.S | TQPT......F....... | ...N.. | .SAKAA.AA.DE | A..A........ | 0.02 | 2 |
| NT... | F.....NR..N..I.T.G | T.P.....DF....... | ..DDR. | ........... | ........... | 0.02 | 2 |
| ..... | ................. | ................. | E..N.. | ..TK...AE..D | ........... | 0.02 | 2 |
| ..... | ................. | ................. | E..ND. | E.AST...E.GS | A..A........ | 0.02 | 2 |
| G...T | F.....ASA.S..T.T.G | .QPG.....DF....... | ...... | ESTTEA...... | A..A........ | 0.02 | 2 |
| ..... | F................ | .V........F....... | ...... | ........... | GRST...VR..H | 0.02 | 2 |
| ..... | ................. | ................. | ...... | ..ARGADAE..S | A..A........ | 0.02 | 2 |
| ..... | F................ | .V........F....... | ...... | ........... | T.AT....S..Q | 0.02 | 2 |
| RA... | F......AG..L.T.N.R | T.PGG....NF....... | ...DD. | .NANRDDAEVGD | A..A........ | 0.02 | 2 |
| GT... | ................. | ..HG.....NF....... | E..TG. | ........... | A..A........ | 0.02 | 2 |
| ..... | F.....ATT..N.L...L | .K.TG....DF....... | R...DR | ........... | A..A........ | 0.02 | 2 |
| ..... | ................. | ................. | ...DD. | E.GTG...EVD. | A..A........ | 0.02 | 2 |
| D.... | F.....STA.RD.P.S.R | ................T | ...DDR | ES.A.S..EFDS | A..A........ | 0.02 | 2 |
| ..... | ................. | ................. | ...DDR | GM...SDAAVDD | A..A........ | 0.02 | 2 |
| .A... | F.....NGG.NN.K.T.R | .........NF....... | R....D | E.ANR..IA.GE | A..A........ | 0.02 | 2 |
| ..... | ................. | ................. | ...... | ........... | GSRTA..NNE.D | 0.02 | 2 |
| G.... | F.....NG..H...I.A.R | .QANH.....F......T | ....GR | ........... | A..A........ | 0.02 | 2 |
| D.... | F.....AT..ND.K.P.K | ................. | ...... | ........... | A..A........ | 0.02 | 2 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| SA..T | F.....DKG.NK.T.A.V | T.YNH.....F....... | E..ND. | ............ | A..A........ | 0.02 | 2 |
| ..... | .................. | .........DF....... | ...... | ..AAGG..AV.G | A..A........ | 0.02 | 2 |
| NT... | F......ET.HN.H...G | .Q.DR.....F....... | ....D. | EDAG...I..GQ | A..A........ | 0.02 | 2 |
| ..... | .................. | T.HTR....DF......T | ...... | ............ | A..A........ | 0.02 | 2 |
| .A... | .................. | .................. | ...... | ESGNTN...VGE | A..A........ | 0.02 | 2 |
| NA..T | F.....GRG.H..P.E.R | ..........F....... | ...... | .SASRND.AVGE | A..A........ | 0.02 | 2 |
| RA..T | F.....SN..PL.K.T.. | ..DGE....DF....... | ...... | ESAR..DAA.DD | A..A........ | 0.02 | 2 |
| ..... | .................. | TKHGG....NF......T | R...D. | ............ | A..A........ | 0.02 | 2 |
| ..... | .................. | .................. | ....D. | ..T.TD.....N | A..A........ | 0.02 | 2 |
| RA..T | .................. | .................. | ....GR | ..TRRD.A.FDN | A..A........ | 0.02 | 2 |
| GA..T | F.....NKT.HL.T.A.R | .QAS......F....... | ...... | .S.ARGDI..DN | A..A........ | 0.02 | 2 |
| ..... | .................. | .................. | ...... | EDGKES.IE.GD | A..A........ | 0.02 | 2 |
| ..... | F................. | .V........F....... | ...... | ............ | GAQAS..AKV.. | 0.02 | 2 |
| ..... | .................. | .................. | E..NG. | E....ND.EF.Q | ............ | 0.02 | 2 |
| A.... | .................. | .KDDG.....NF...... | ...... | E..RRA.....Y | A..A........ | 0.02 | 2 |
| E.... | F.....DNT.SK.L...K | .QPN......F......T | ...... | ..AGAN....GG | A..A........ | 0.02 | 2 |
| ..... | .................. | .................. | ...... | ..AG.N.AA.DQ | A..A........ | 0.02 | 2 |
| ..... | .................. | .................. | R..AD. | .DAG.SD...GG | A..A........ | 0.02 | 2 |
| ..... | .........V........ | .................. | E..AG. | ............ | ............ | 0.02 | 2 |
| ..... | F................. | .V........F....... | ...... | ............ | GSRTG..NR..A | 0.02 | 2 |
| ..... | .................. | .................. | ....D. | .DTAA...EF.G | A..A........ | 0.02 | 2 |
| ..... | .................. | .........NF......T | R..TDR | ............ | A..A........ | 0.02 | 2 |
| DT... | F.....NAG.LA...Q.R | .........NF....... | R,..D. | ..GT..DAAY.E | A..A........ | 0.02 | 2 |
| ..... | .................. | .................. | G..A.R | ............ | A..A........ | 0.02 | 2 |
| .A... | F.....AS..LE.M.T.R | .QDT......F......T | ...D.. | .D.RTAD.E.DH | A..A........ | 0.02 | 2 |
| ..... | F................. | .V........F....... | ...... | ............ | K.KT....RE.E | 0.02 | 2 |
| ..... | F................. | .V........F....... | ...... | ............ | .QQG...STG.. | 0.02 | 2 |
| NA... | F.....NKT.HL.T.A.R | TQHNH.....F......T | ...... | ............ | A..A........ | 0.02 | 2 |
| ..... | .................. | ....E.....F....... | ...AD. | ............ | A..A........ | 0.02 | 2 |
| D...T | F.....S...PN.T.G.E | ..YN......F......T | ...D.R | ............ | A..A........ | 0.02 | 2 |
| DT... | F.....DTG.SK.T.T.R | .QHNQ.....F......T | ....GR | ENAG.SD.E..H | A..A........ | 0.02 | 2 |
| TA... | F......EG.LQ.M.A.K | TKA......NF......T | ...D.. | ............ | A..A.....V.. | 0.02 | 2 |
| ..... | F................. | .V........F....... | ...... | ............ | GQRAA..N.N.T | 0.02 | 2 |
| ..... | .................. | .V........F....... | ...... | E.GGAN.IA.GQ | A..A........ | 0.02 | 2 |
| ..... | F................. | .V........F....... | ...... | ............ | .RQSG..FDM.D | 0.02 | 2 |
| E.... | F.....GAT.PN.H.H.G | ..DGE....DF....... | ...... | ESGR.GDI..DD | A..A........ | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| .T... | .................. | .........NF..P...T | R..ND. | ........... | A..A........ | 0.02 | 2 |
| ....T | F.....SA..RA.....R | .................. | ...DDR | ........... | A..A........ | 0.02 | 2 |
| TA... | F.....GNG.NE.L.P.R | .Q.DH....NF....... | ...DD. | ...GTS..EF.Q | A..A........ | 0.02 | 2 |
| GT... | F.......G.HK.T.N.G | ..HG.....NF......T | E..N.. | E.......... | A..A........ | 0.02 | 2 |
| ..... | .................. | .........DF....... | ...ADR | .D...S..A.GG | A..A........ | 0.02 | 2 |
| EA... | .................. | .QPSR.....F......T | ...D.. | .DAG.S.A..DR | A..A........ | 0.02 | 2 |
| GA..T | F.....DKG.P..T...G | ..PN.....NF....... | ...... | ........... | A..A........ | 0.02 | 2 |
| AA... | F.....GG..NK.M.... | .QPSE....DF....... | R..D.. | ........... | A..A........ | 0.02 | 2 |
| ..... | .................. | .........NF....... | R...D. | EDT.EGDI..DR | A..A........ | 0.02 | 2 |
| .A... | P.....DRG.N..I.A.K | .................. | ...... | ENASG.....GN | A..A........ | 0.02 | 2 |
| TT... | F.....SN..PL.K.T.. | .................. | ...... | ........... | A..A...A.... | 0.02 | 2 |
| ST... | .................. | .................. | ...... | ........... | ........... | 0.02 | 2 |
| SA... | .................. | .V........F....... | ...... | EDAGT...AFD. | A..A........ | 0.02 | 2 |
| T...T | F.....ATT..N.L...L | .Q.DR.....F....... | ....D. | ........... | A..A........ | 0.02 | 2 |
| R...T | F.....GTA.NV.L...M | ..DGE....DF....... | ....DR | .NAGASDA.FDQ | A..A........ | 0.02 | 2 |
| G.... | F.......T.SV...H.R | .Q.DR.....F....... | ....D. | .SAKAA.AA.DE | A..A........ | 0.02 | 2 |
| A.... | F.....GTG..P.T.D.R | TQPNH.....F....... | R..D.. | ........... | A..A........ | 0.02 | 2 |
| ..... | .................. | .PHD.....DF......T | R..DG. | ........... | A..A........ | 0.02 | 2 |
| ..... | F................. | .V........F....... | ...... | ........... | K.RTA..A.G.D | 0.02 | 2 |
| RA... | F.....ASA.S..T.T.G | .QPG.....DF......T | ...AD. | ........... | A..A........ | 0.02 | 2 |
| .A... | F.....NTG.RN.T.T.L | .........NF....... | R...D. | ES.GRGD...DR | A..A........ | 0.02 | 2 |
| HT... | F................. | .V........F....... | ...... | ........... | ........... | 0.02 | 2 |
| R.... | F.....GDG....K.Q.R | .Q.DR.....F....... | ....D. | ESAGA.D.A..R | A..A........ | 0.02 | 2 |
| ..... | .................. | .................. | ...N.. | ..TG.A.I..D. | A..A........ | 0.02 | 2 |
| ..... | F.....GKA.LD.P.D.R | .................. | ...D.. | ........... | A..A........ | 0.02 | 2 |
| H.... | .................. | ..HG.....NF......T | E..DD. | ........... | A..A........ | 0.02 | 2 |
| TA..T | F.....DQG.S..L...G | ..P.G....KF....... | ...DDR | .NAG.DD...DQ | A..A........ | 0.02 | 2 |
| HA... | F.....AGT.PM.K.K.G | .QDGH....DF.....T | ...DD. | E.AGRN.T..DD | A..A........ | 0.02 | 2 |
| ..... | .................. | .................. | ....D. | .NGR.G..A..E | A..A........ | 0.02 | 2 |
| ..... | F................. | .V........F....... | ...... | ........... | TAKGR...T..A | 0.02 | 2 |
| ..... | .................. | .................. | ...... | EDAGT...AFD. | A..A........ | 0.02 | 2 |
| TT... | F.....STA..Q.H.Q.L | ..HG.....NF......T | ...A.. | ........... | A..A........ | 0.02 | 2 |
| A...T | F......S..PM.T.S.K | ..YN......F......T | ...D.R | ........... | ........... | 0.02 | 2 |
| SA..T | F.....A...HA.K.N.R | T.AG.....NF......T | R...D. | ..GAGGDAEF.Q | A..A........ | 0.02 | 2 |
| DT..T | F.....NG..LK.T.K.K | .QANH....DF....... | ...DDR | ........... | A..A........ | 0.02 | 2 |
| AA... | .................. | .................. | R..DDR | .SGGRS..AFGD | A..A........ | 0.02 | 2 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ................. | ....D. | E.AGAND.AY.N | A..A........ | 0.02 | 2 |
| TA... | F.....AGT..M.K.Q.G | .PPNG.....F......T | ...DDR | ............ | A..A........ | 0.02 | 2 |
| A.... | ................. | .KYT.....NF...... | ...D.. | ............ | A..A........ | 0.02 | 2 |
| ..... | ................. | ................. | ...DDR | E.GRAADAAF.E | A..A........ | 0.02 | 2 |
| RT... | F......T..HP.L.H.R | .QPG.....NF...... | ...DDR | ..TGAS.A..DH | A..A........ | 0.02 | 2 |
| DT... | ................. | ................. | ....D. | ............ | A..A........ | 0.02 | 2 |
| R.... | F.....NAT.IM.T.H.R | .QDT......F......T | ...D.. | .NAGA.D...GS | A..A........ | 0.02 | 2 |
| ..... | F................. | .V........F...... | ...... | ............ | TPRG...NTT.D | 0.02 | 2 |
| NA... | F.....GRG.NQ.K.E.H | .Q.GQ....DF...... | ....G. | E.GAGSD.E.D. | A..A........ | 0.02 | 2 |
| AA... | F.....GRG.SP.K...G | .QPG.....NF...... | ...DDR | ENGGGG.I..GH | A..A........ | 0.02 | 2 |
| T...T | ................. | T.ANE.....F...... | ...DDR | ..GDRN.AA.GE | A..A........ | 0.02 | 2 |
| NA... | F.....AQ...A.L.... | TQYNR.....F...... | ...... | ............ | A..A........ | 0.02 | 2 |
| TA... | ................. | .Q.S......F...... | E..ND. | ENAGASDIA.DH | A..A........ | 0.02 | 2 |
| TA..T | F.....AN..RH...E.K | ..DGE....DF...... | ...D.. | .NAGEG...VDS | A..A........ | 0.02 | 2 |
| ..... | ................. | ........DF...... | ...DDR | ..TTGA..AY.D | A..A........ | 0.02 | 2 |
| ..... | ................. | ................. | ...ADR | ..AS...I..G. | A..A........ | 0.02 | 2 |
| ..... | ................. | ................. | R..DD. | ...AGADIA.DE | A..A........ | 0.02 | 2 |
| G.... | ................. | ................. | E...DR | .SAGAN..E..S | A..A........ | 0.02 | 2 |
| G.... | ................. | ..ATG....NF..P...T | ...... | E..RRD.AA..H | A..A........ | 0.02 | 2 |
| GT... | ................. | ................P.... | E..KG. | ............ | A..A........ | 0.02 | 2 |
| G...T | F.....GN..IK.L...G | ...DG....DF...... | ...DDR | ..TG.S...V.E | A..A........ | 0.02 | 2 |
| SA..T | F.....GNG.HV.H.G.R | ............P.... | ...... | ............ | A..A........ | 0.02 | 2 |
| D...T | F.....SGA..K.N.S.S | .Q.DR.....F......T | ....D. | ESAR..DAA.DD | A..A........ | 0.02 | 2 |
| NT... | F................. | .V........F...... | ...... | ............ | ............ | 0.02 | 2 |
| ..... | ................. | .V........F...... | ...... | ..TGTS...YGS | A..A........ | 0.02 | 2 |
| ..... | F................. | .V........F...... | G..TG. | ............ | KDRTP..FQA.D | 0.02 | 2 |
| ..... | F.....ATG.NV.T.G.R | ..DGE....DF...... | ...... | ENGTASD.AF.E | A..A........ | 0.02 | 2 |
| TT... | ................. | TQA.H....DF...... | ...... | ............ | A..A........ | 0.02 | 2 |
| ..... | F................. | .V........F....T | ...... | ............ | GTRDA..VQE.A | 0.02 | 2 |
| TT.ST | ................. | ................. | ...... | ............ | ............ | 0.02 | 2 |
| SA... | .I................ | .QAS......F...... | ...... | ED.TTGDA...G | A..A........ | 0.02 | 2 |
| GT... | F.....AEG.LK.M.H.L | ..DGE....DF...... | ...... | E........... | ............ | 0.02 | 2 |
| T.... | F.....GS..NK.M.A.R | .QPSR.....F...... | ...... | ESAAG.D.AF.S | A..A........ | 0.02 | 2 |
| ..... | ................. | T.HDR....NF...... | ...DDR | EN.G..DIE..S | A..A........ | 0.02 | 2 |
| ..... | ................. | T.P......DF...... | ...D.. | ............ | A..A........ | 0.02 | 2 |
| ..... | ................. | ................. | R..DD. | .NGG.ND....Q | A..A........ | 0.02 | 2 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | ................. | .................. | ...DDR | E.ASG..I.VGR | A..A........ | 0.02 | 2 |
| D.... | F.....AEA..I.K.H.. | .QPSH....DF....... | ....G. | .SA.GG....DG | A..A........ | 0.02 | 2 |
| ..... | F.....ASA.S..T.T.G | .KPDQ.....F....... | ...DDR | ............ | ............ | 0.02 | 2 |
| E.... | F................ | .V........F....... | E..NG. | ............ | ............ | 0.02 | 2 |
| SA... | F.....NGG.NV.N.K.G | ..YN............. | ...... | .NAT.ND.AFGE | A..A........ | 0.02 | 2 |
| RA... | ................. | .........NF....... | R...D. | E..RRD.AA..H | A..A........ | 0.02 | 2 |
| DA..T | F.....DHT.R..M.G.R | .QDT.....DF....... | G..TG. | ............ | A..A........ | 0.02 | 2 |
| ..... | ................. | ....G.....F....... | ....G. | .NADRN..E.GE | A..A........ | 0.02 | 2 |
| ..... | ................. | TQDGQ....NF....... | R..... | .D.GA.DIE.DR | A..A........ | 0.02 | 2 |
| TT..T | F.....NGG.NI.K.E.R | ..DGE....DF....... | ...... | ESTDGG..A.DS | A..A........ | 0.02 | 2 |
| ..... | ................. | .................. | E..DD. | ............ | ............ | 0.02 | 2 |
| ..... | F................ | .V........F....... | ...... | ............ | TQRSP..S...T | 0.02 | 2 |
| DT... | .......AST.IN.L.T. | ..DGE....DF....... | ...... | ............ | ............ | 0.02 | 2 |
| ..... | ................. | .................. | E..ND. | E.AG.D...YGR | A..A........ | 0.02 | 2 |
| RA... | ................. | .................. | ...DDR | ............ | GRSAG..AG..A | 0.02 | 2 |
| NA..T | F.....AGG.P..L...G | ..PN.....NF....... | ...NDR | ............ | A..A........ | 0.02 | 2 |
| ..... | ................. | .................. | ...... | E.AGG.D.E.DS | A..A........ | 0.02 | 2 |
| H.... | F.....SA..RA.....R | .V........F....... | ...... | ESARGS..EFDG | A..A........ | 0.02 | 2 |
| ..... | F................ | .V........F....... | ...... | ............ | GRSGR...EG.T | 0.02 | 2 |
| ..... | F.....AGA.SL.....R | T.ANE....F....... | ...D.. | ............ | A..A........ | 0.02 | 2 |
| ..... | F................ | .V........F....... | ...... | ............ | ATKTN...R... | 0.02 | 2 |
| TT... | ................. | .................. | E..KD. | ............ | ............ | 0.02 | 2 |
| D.... | ......NRG.PV.N.A.. | ..YN......F......T | ...D.R | ..ARRG..A.DE | A..A........ | 0.02 | 2 |
| H.... | F.....SN..PL.K.T.. | .KYT.....NF......T | ...... | ............ | A..A........ | 0.02 | 2 |
| AT..T | F.....A.G..V.T.H.R | .........F....... | ...... | ............ | A..A........ | 0.02 | 2 |
| ..... | P.....GS..NK.M.A.R | ..YN......F......T | ...D.R | ............ | A..A........ | 0.02 | 2 |
| ..... | F.........HK.P.N.G | TQ.TH....DF....... | ...DDR | ............ | A..A........ | 0.02 | 2 |
| ST..T | ................. | .Q.DQ.....F....... | R..DD. | ............ | A..A........ | 0.02 | 2 |
| ..... | ................. | .................. | ...RDG | ESTDRG.A..GE | A..A........ | 0.02 | 2 |
| AA... | ................. | .KDSR....DF....... | ....D. | EDGGRG...V.D | ............ | 0.02 | 2 |
| SA..T | ................. | .................. | ...... | ENTTGN....DR | A..A........ | 0.02 | 2 |
| ..... | F................ | .V........F....... | ...... | ............ | GSRAS..AT..K | 0.02 | 2 |
| NT... | F.....NR..N..I.T.G | TKPS.....DF......T | G..AD. | ............ | A..A........ | 0.02 | 2 |
| RA... | F.....GN..IK.L...G | ...NG.....F....... | R..N.. | E.AGGN..E.DD | A..A........ | 0.02 | 2 |
| .A... | F.....SNG.RE.L...K | TQ.TG....NF....... | ...... | ............ | A..A........ | 0.02 | 2 |
| ..... | F................ | .V........F....... | ...... | ............ | GPKAA..V.G.T | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | .................. | R..DG. | E..GASD.A..Q | ............ | 0.02 | 2 |
| ..... | .................. | .QD.E.....F..P.... | ...D.R | ............ | A..A........ | 0.02 | 2 |
| ..... | F.....GTG.P....K.. | .KYT.....NF......T | ...D.. | ............ | A..A........ | 0.02 | 2 |
| ..... | F................. | .V........F....... | ...... | ............ | ERRTH...TE.. | 0.02 | 2 |
| NT..T | ............H...R | .QANH.....F......T | ...D.. | ENG.AG....DQ | A..A........ | 0.02 | 2 |
| GT... | F.....GRG.H..P.E.R | .Q.S......F....... | ...... | .DGAGGD.A..Q | A..A........ | 0.02 | 2 |
| ..... | .................. | .................. | ...DDR | ESTTGADT..GG | A..A........ | 0.02 | 2 |
| ..... | F................. | .V........F....... | ...... | ............ | GPRA...FNE.H | 0.02 | 2 |
| ..... | F................. | .V........F....... | ...... | ............ | GTKAP...GE.T | 0.02 | 2 |
| ..... | .................. | .................. | ...NGR | .SAT.N.IA..H | A..A........ | 0.02 | 2 |
| ..... | .................. | ..A......DF....... | ....D. | .SATTGD..VDR | A..A........ | 0.02 | 2 |
| E.... | .................. | .........DF......T | R..DG. | .NAG.S.IAFGN | A..A........ | 0.02 | 2 |
| ..... | .................. | .V........F....... | ...... | ............ | GPHS...FQS.D | 0.02 | 2 |
| TA... | .................. | .Q.S......F....... | E..N.. | .SAGEND.E.GH | A..A........ | 0.02 | 2 |
| ..... | F................. | .V........F....... | ...... | ............ | SDRST..STG.. | 0.02 | 2 |
| ..... | .................. | .................. | G..DD. | ESGN.N.A..GS | A..A........ | 0.02 | 2 |
| ..... | .................. | .................. | ...... | ESAGTG..AY.H | A..A........ | 0.02 | 2 |
| AA... | .................. | .Q.S......F......T | ...DD. | E.TGGGD.AV.. | A..A........ | 0.02 | 2 |
| ..... | .................. | .........DF....... | ...D.. | .DAG.....VGN | A..A........ | 0.02 | 2 |
| DA... | F.....SA..RA.....R | TQDS.....NF....... | E..NG. | EN.KA.DAE..D | A..A........ | 0.02 | 2 |
| R.... | .................. | TKPN.....NF....... | R...D. | ESAGTNDAEVGD | A..A........ | 0.02 | 2 |
| SA... | F.....GG..I..P...R | .Q.GQ....DF....... | ....G. | .D.GA.DIE.DR | A..A........ | 0.02 | 2 |
| NA..T | F.....GN..NA.T...M | .Q.......DF....... | ...ADR | ............ | A..A........ | 0.02 | 2 |
| EA..T | F.....NNG..V.K.P.R | .Q.......DF....... | R...D. | .DTG.N..A..R | A..A........ | 0.02 | 2 |
| D...T | .................. | .................. | ...DG. | .NGGTG..A.DR | A..A........ | 0.02 | 2 |
| GT... | F.....GNG.HV.H.G.R | .........DF....... | ...... | ............ | ............ | 0.02 | 2 |
| ..... | F................. | .V......N.F....... | ...... | ............ | NARDN..DDS.. | 0.02 | 2 |
| .A... | F......GT.NM.L.Q.G | ..DGE....DF....... | ...... | ............ | ............ | 0.02 | 2 |
| .A... | F................. | .V......F....... | ...... | ............ | ............ | 0.02 | 2 |
| ..... | .................. | .................. | R...D. | ...SGSD..FDN | A..A........ | 0.02 | 2 |
| SA..T | .................R | .QPN......F......T | ...N.. | ..AKGNDAAV.Q | ............ | 0.02 | 2 |
| ..... | F.....ANG.HL.K.K.S | .Q.......DF....... | ...AD. | ............ | A..A........ | 0.02 | 2 |
| ..... | .................. | .................. | ...DDR | ...TG.D.AY.G | A..A........ | 0.02 | 2 |
| ..... | F................. | .V........F....... | ...... | ............ | A.HNA..DQE.Q | 0.02 | 2 |
| ...T. | .................. | .................. | ...DDR | E..TA.D...GR | A..A........ | 0.02 | 2 |
| ..... | F.......G.PK.L...H | .........NF....... | ...... | ............ | A..A........ | 0.02 | 2 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| SA... | F.....AEG.NI.L.K.R | .........NF....... | ...DD. | ........... | A..A........ | 0.02 | 2 |
| .A... | F.....DHT.R..M...R | ................. | ...... | ........... | A..A........ | 0.02 | 2 |
| ..... | F............... | .Q.DR.....F...... | ....D. | EN.AGN.IE.GN | A..A........ | 0.02 | 2 |
| ..... | ................. | ................. | ....D. | .NTSAS..EFDR | A..A........ | 0.02 | 2 |
| DA... | F............... | ................. | ...DDR | ........... | ........... | 0.02 | 2 |
| ..... | ................. | .........DF...... | R...D. | .SAKAA.AA.DE | A..A........ | 0.02 | 2 |
| AT... | ................. | ...TG....NF...... | R..AD. | EDAKGG.....R | A..A........ | 0.02 | 2 |
| DT... | ................. | ................. | ...TG. | .S.G.S.IA..D | A..A........ | 0.02 | 2 |
| A.... | ................. | TQPTH....NF...... | ...DDR | EDAA.SD..Y.D | A..A........ | 0.02 | 2 |
| EA... | F.....GN..PL.K.T.. | ..ADH....DF...... | ...D.. | ES.TEN....GR | A..A........ | 0.02 | 2 |
| ..... | ................. | ..PN.....DF...... | ...DDR | E.AKRGD.A..G | A..A........ | 0.02 | 2 |
| ..... | F.....GRG.H..P.E.R | .QAS......F...... | ...... | ENTSEG.....R | A..A........ | 0.02 | 2 |
| E.... | ................. | ................. | ....GR | ..AG.N.AA.GQ | A..A........ | 0.02 | 2 |
| ..... | F......GT.NM.L.Q.G | TQ.TG....DF...... | ...DDR | ........... | A..A........ | 0.02 | 2 |
| ..... | ................. | T..G....DF...... | ....D. | ..ARGADAE..S | A..A........ | 0.02 | 2 |
| ..... | ................. | .........NF......T | ...D.R | .SAS.N.IA..E | A..A........ | 0.02 | 2 |
| R.... | ................. | ..DGE....DF...... | ...... | ESGSGSD..FDH | A..A........ | 0.02 | 2 |
| ..... | F............... | .V........F...... | ...... | ........... | DHRT...ADG.T | 0.02 | 2 |
| E.... | F.....DA..IA.L.K.R | .KDSR....DF......T | R..DD. | ........... | A..A........ | 0.02 | 2 |
| ..... | ................. | ................. | ...DD. | E.GT.ND.A.DG | A..A........ | 0.02 | 2 |
| D...T | F.....AG.....T.D.R | ................. | R...D. | ..A.EGD.E... | A..A........ | 0.02 | 2 |
| D.... | F.....SNG.RE.L...K | .QPN......F......T | ...N.. | ........... | A..A........ | 0.02 | 2 |
| ..... | F............... | .V........F...... | ...... | ........... | G.KAH..DRS.. | 0.02 | 2 |
| DT... | F............... | .V........F...... | ...... | ........... | GSSAG..AQV.Q | 0.02 | 2 |
| ..... | ................. | ................. | R..KD. | ........... | A..A........ | 0.02 | 2 |
| NA..T | ......NKG.NL.N.T.E | .QPG.....DF...... | ...... | ........... | A..A........ | 0.02 | 2 |
| ..... | ................. | ................. | ...D.. | EDAGRND.AFDH | A..A........ | 0.02 | 2 |
| ..... | ................. | ..........F...... | ...NDR | ESAAR.DA.FD. | A..A........ | 0.02 | 2 |
| ..... | F............... | .V........F...... | ...... | ........... | S.RAG..FQI.Q | 0.02 | 2 |
| ..... | ................. | ................. | ...D.. | .SANES.A...N | A..A........ | 0.02 | 2 |
| ..... | ................. | ..........F...... | ...D.. | ........... | A..A........ | 0.02 | 2 |
| TA..T | F............... | ................. | ...... | ........... | ........... | 0.02 | 2 |
| NA..T | F............... | ................. | ....D. | .S.G.S.IA..G | A..A........ | 0.02 | 2 |
| G.... | F.....A...ND.T...K | .Q.DH....NF...... | ...DD. | ........... | A..A........ | 0.02 | 2 |
| ..... | F.......G.HK.T.N.G | ..HG.....NF......T | E..N.. | E.......... | A..A........ | 0.02 | 2 |
| ..... | F............... | ................. | E..DG. | ........... | ........... | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F................ | .V........F....... | ...... | ............ | T..DG..FTA.D | 0.02 | 2 |
| G.... | F.....SA..SI.M.G.R | ..HG.....NF......T | ...A.. | ..ANRD.A..DQ | A..A........ | 0.02 | 2 |
| DA..T | F.....NA..PI.P.P.R | .Q.DR.....F....... | ....D. | ............ | A..A........ | 0.02 | 2 |
| T.... | F.....AKG.P..H.P.R | ................. | ...D.. | E.AGAADA.VDH | A..A........ | 0.02 | 2 |
| ..... | ................ | ................. | ...DGR | ..AGEA...VDG | A..A........ | 0.02 | 2 |
| ..... | ................ | ................T | R..TGR | ............ | A..A........ | 0.02 | 2 |
| ..... | F................ | .V........F....... | ...... | ............ | TQRG...ADM.A | 0.02 | 2 |
| ..... | ................ | ................. | R..... | ED.GR..I..DN | A..A........ | 0.02 | 2 |
| ..... | F................ | .V........F....... | ...... | ............ | T.RT...VKA.D | 0.02 | 2 |
| HA... | F...........M.K.R | T.PTG....DF....... | ...DGR | ............ | A..A........ | 0.02 | 2 |
| ..... | F.....AG..RE.L...K | TQ.TG....DF....... | ...DDR | .SGAGAD.E.GE | A..A........ | 0.02 | 2 |
| ..... | F................ | .V........F....... | ...... | ............ | ..QTA..VEG.H | 0.02 | 2 |
| DA... | ................ | ................. | ...AG. | .NAG.DD...DQ | A..A........ | 0.02 | 2 |
| NA..T | F................ | TKAT.....NF......T | R..ND. | .SARG..A..DE | A..A........ | 0.02 | 2 |
| N.... | F.....DT..LK.T.H.G | .QPTG....NF....... | E..AGR | ............ | DPRDE..VEM.H | 0.02 | 2 |
| TT... | F.....ATG.NV.T.G.R | ..DGE....DF....... | ...... | ENA..ND.A.DR | A..A........ | 0.02 | 2 |
| ..... | F................ | .V........F....... | ...... | ............ | A..TG..DGT.E | 0.02 | 2 |
| E.... | F.....DAG.NA.L.S.R | .Q.S.....NF....... | ...D.R | ES.DRN.....Q | A..A........ | 0.02 | 2 |
| ..... | F................ | .V........F....... | ...... | ............ | DTKA...NS..E | 0.02 | 2 |
| ..... | ................ | ................. | ....D. | ENTATDD...GH | A..A........ | 0.02 | 2 |
| ..... | F.....SAA.NM.M.A.L | .KAS.....NF......T | ...... | ............ | A..A........ | 0.02 | 2 |
| HA... | F................ | ................. | ...DDR | EN.GTN.AE.DN | A..A........ | 0.02 | 2 |
| ..... | ................ | ................. | E..D.. | EDGKGA....GE | A..A........ | 0.02 | 2 |
| HT... | ................ | ................. | E..NG. | ............ | ............ | 0.02 | 2 |
| .A... | F.....NGG.RA.N.E.R | ..DGE....DF....... | ....GR | E.TR.N.....E | A..A........ | 0.02 | 2 |
| ..... | F................ | .V........F....... | ...... | ............ | GKRDP..NSE.. | 0.02 | 2 |
| ..... | ................ | ........DF....... | ...D.R | EDTG.A....GN | A..A........ | 0.02 | 2 |
| SA... | ................ | ........NF....... | R...D. | .DGTGGD.A..R | A..A........ | 0.02 | 2 |
| NA... | F................ | TKHGG....NF....... | R..DD. | ............ | A..A........ | 0.02 | 2 |
| ..... | ................ | ................. | R..D.. | E..GTG..E.DS | A..A........ | 0.02 | 2 |
| ..... | F................ | .V........F....... | ...... | ............ | GTRNG.TDNS.E | 0.02 | 2 |
| G.... | F.....NGG.HV...W.L | .QP.G.....F....... | G..KD. | .NATGND.E..H | A..A........ | 0.02 | 2 |
| NT... | F.....SA..RA.....R | .........NF....... | R...D. | E.TGGNDAE.DD | A..A........ | 0.02 | 2 |
| DA..T | F.....NGG.NI.K.E.R | .QAS.....NF......T | ....GR | .SAKAA.AA.DE | A..A........ | 0.02 | 2 |
| RA... | ................ | .KYT.....NF......T | ...DDR | .NGGGN...VDQ | A..A........ | 0.02 | 2 |
| ..... | F................ | .V........F....... | ...... | ............ | ERRSP...GE.D | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F................ | .V........F....... | ...... | ........... | ANKNG..SSV.A | 0.02 | 2 |
| .A... | F................ | T.DT.....DF......T | R..TGR | ........... | ........... | 0.02 | 2 |
| E.... | ................ | ................ | ...... | ..ANTN.TA.DS | A..A........ | 0.02 | 2 |
| SA... | F.....GDG.RA.....V | ..DGE....DF......T | G..AD. | E.AGAA..E.DR | A..A........ | 0.02 | 2 |
| ..... | ................ | ................ | E..... | ..TGRD...F.R | A..A........ | 0.02 | 2 |
| TA... | F.....SGT.NM.K.T.E | .Q.DH....NF......T | ...D.R | ........... | A..A........ | 0.02 | 2 |
| A...T | ................ | TQ.TG....DF....... | ...DD. | ..T.G...A..E | A..A........ | 0.02 | 2 |
| TT... | F.....DK...M.K.P.M | .KPSE....DF......T | ...ADR | ........... | A..A........ | 0.02 | 2 |
| ..... | ................ | ................ | ...N.R | E.AGAND.AY.N | A..A........ | 0.02 | 2 |
| ..... | ................ | .KDSR....DF....... | R..D.. | ..TK...AE..D | A..A........ | 0.02 | 2 |
| ..... | ................ | ................ | ...TG. | ........... | A..A........ | 0.02 | 2 |
| D...T | F................ | ..........F....... | ....D. | ...GEA...YDR | A..A........ | 0.02 | 2 |
| ....T | F.....D...S..M.T.R | .........NF....... | ....D. | ESAG...TEYD. | A..A........ | 0.02 | 2 |
| ..... | F................ | .V........F....... | ...... | ........... | GRRDP..NEG.. | 0.02 | 2 |
| T.... | F.....GN..NA.T...M | T.PTG....DF....... | ...DDR | ........... | A..A........ | 0.02 | 2 |
| ..... | F.........I....... | .........NF....... | R...D. | E.AAAD.I..GQ | A..A........ | 0.02 | 2 |
| GT... | F................ | .V........F....... | ...... | ........... | A..A........ | 0.02 | 2 |
| ..... | ................ | ................ | ...AG. | E.TD.A....DG | A..A........ | 0.02 | 2 |
| ..... | ................ | ................ | ...D.. | ENGRGD..AY.D | A..A........ | 0.02 | 2 |
| ..... | F................ | .V........F....... | ...... | ........... | T.RD...ARI.. | 0.02 | 2 |
| ..... | F................ | ..HG.....NF......T | E..DD. | ........... | ........... | 0.02 | 2 |
| D.... | F.....SRA.SK.N.A.H | ..DGE....DF....... | ...... | ........... | A..A........ | 0.02 | 2 |
| ..... | ................ | .........NF....... | ...DDR | EDAG...I..GQ | A..A........ | 0.02 | 2 |
| TA... | ................ | T.P......DF....... | ...D.. | ........... | A..A........ | 0.02 | 2 |
| SA... | F.....AKG.P..H.P.R | T.PGG....NF....... | ...DD. | ...TGS.IEFDG | A..A........ | 0.02 | 2 |
| RT... | F................ | .QPTG....NF....... | ...... | ........... | A..A........ | 0.02 | 2 |
| D...T | ................ | .Q.S......F....... | R..AD. | ........... | A..A........ | 0.02 | 2 |
| NA..T | F.....GTG..P.T.D.R | T.P......DF....... | ...D.. | ........... | A..A........ | 0.02 | 2 |
| AA... | ................ | .QHNQ.....F......T | ...N.. | E.ANRN..EF.D | A..A........ | 0.02 | 2 |
| ..... | ................ | ................ | ...... | ENGD....E.DR | A..A........ | 0.02 | 2 |
| ..... | F................ | .V........F....... | ...... | ........... | .ARSP...R..E | 0.02 | 2 |
| G.... | ................ | TQ.GR....NF....... | ...... | ........... | A..A........ | 0.02 | 2 |
| R.... | ................ | TQ.NQ.....F..P.... | R...DR | ........... | A..A........ | 0.02 | 2 |
| ..... | ................ | ................ | R..N.. | ..AG.N.AA.GQ | A..A........ | 0.02 | 2 |
| ..... | ................ | ................ | ...ADR | ..AG.N.AA.GQ | A..A........ | 0.02 | 2 |
| ..... | ................ | ................ | E..A.. | ........... | A..A........ | 0.02 | 2 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F.....A.A.RP.I...L | ..DGE....DF....... | R..... | .SGAG.D..F.N | A..A........ | 0.02 | 2 |
| SA... | F.....AG..PE.H.Q.V | .K.TG....DF....... | R...DR | ........... | A..A........ | 0.02 | 2 |
| ..... | ................. | ................. | ...... | ..AKG...EFG. | A..A........ | 0.02 | 2 |
| ..... | ................. | ................. | R..TGR | ..AG.SD.EVG. | A..A........ | 0.02 | 2 |
| ..... | ................. | .KYT.....NF....... | R..D. | ED.GGND.EV.D | A..A........ | 0.02 | 2 |
| ..... | ................. | ................. | ...N. | ...AAS.A.VGQ | A..A........ | 0.02 | 2 |
| ..... | ................. | ................. | ...D.R | E.GAGAD...GQ | A..A........ | 0.02 | 2 |
| RA... | ................. | .........NF..P...T | R.ND. | ........... | A..A........ | 0.02 | 2 |
| ..... | ................. | ................. | ...... | GDTTGS.AA..E | A..A........ | 0.02 | 2 |
| GT... | F.....SRA.SK.N.A.H | .QDT.....DF....... | ...DDR | ...G.S..AFGD | A..A........ | 0.02 | 2 |
| GA... | F.....NAG.IN.N...L | ..HG.....NF......T | ...DDR | ........... | A..A........ | 0.02 | 2 |
| NT..T | F......KT.NV.K.T.H | ................. | ...... | ........... | A..A........ | 0.02 | 2 |
| DA... | F.....A.G.SL.K.Q.G | ................. | G..ND. | ........... | A..A........ | 0.02 | 2 |
| EA... | F.....DKG.HM.L.G.R | .........NF....... | ...D.. | .DAS.N...VDG | A..A......I. | 0.02 | 2 |
| ..... | ................. | ................. | E..AD. | ..AT.DD..FDG | A..A........ | 0.02 | 2 |
| AA... | ......GRG..Q.T.G.R | .RPT......F..P...T | ...ND. | .NAGA.D...GS | A..A........ | 0.02 | 2 |
| D.... | ................. | ................. | R..... | EN.AADD.A.GD | A..A........ | 0.02 | 2 |
| ET..T | F................ | .V.......F....... | ...... | ........... | A..A........ | 0.02 | 2 |
| A...T | F.....SRT.IQ.....G | .Q.DR.....F....... | ....D. | ........... | A..A........ | 0.02 | 2 |
| ..... | ................. | ................. | ...D.. | E.TG.G.T...Q | A..A........ | 0.02 | 2 |
| ..... | ................. | ................. | R..ND. | ..AGEN..A..G | A..A........ | 0.02 | 2 |
| SA... | F.....SGT.S..T.T.. | ..AGR....DF......T | R..D.. | ........... | A..A........ | 0.02 | 2 |
| SA... | F.....A.A.RE.I.... | ..DGE....DF....... | ...... | ...ARD.IA..G | A..A........ | 0.02 | 2 |
| ..... | ................. | ................. | E..AD. | E.AAAN..E.DG | A..A........ | 0.02 | 2 |
| ..... | ................. | ................. | R..ADR | EN.D...A..GD | A..A........ | 0.02 | 2 |
| ..... | F.....SS..SV.P.D.H | .........DF....... | E..AD. | ........... | A..A........ | 0.02 | 2 |
| E.... | ................. | .........NF..P...T | R...D. | .D.K.G..E.GQ | A..A........ | 0.02 | 2 |
| ..... | ................. | ................. | ...DG. | ..ARGA.AE..S | A..A........ | 0.02 | 2 |
| ..... | ................. | ................. | ...D.. | ENAGASD1A.DH | A..A........ | 0.02 | 2 |
| EA... | ................. | ................. | E..DD. | ........... | A..A........ | 0.02 | 2 |
| ..... | ................. | ................. | R..... | EDAG.AD.E.G. | A..A........ | 0.02 | 2 |
| G.... | F................ | ..HG.....NF......T | E..DD. | ........... | A..A........ | 0.02 | 2 |
| ..... | ................. | .K.TG....DF....... | R...DR | ..ATRS.I..GN | A..A........ | 0.02 | 2 |
| TA..T | F.....AG..PA.K.G.R | ..YN......F.....T | ...... | E.GNGS....GR | A..A........ | 0.02 | 2 |
| G.... | F.....SRA.SK.N.A.L | ..DGE....DF....... | ...... | ..AAE.D....N | A..A........ | 0.02 | 2 |
| HT..T | F.....SA..RA.....R | .........NF....... | R...D. | E.TGGNDAE.DD | A..A........ | 0.02 | 2 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F................. | .V........F....... | ...... | ............ | TPRTA..NR..P | 0.02 | 2 |
| ..... | F................. | .V........F....... | ...... | ............ | .DRAA..IRE.H | 0.02 | 2 |
| ..... | ................. | .................T | ...D.. | ............ | A..A........ | 0.02 | 2 |
| ..... | ................. | .........DF..P...T | ...... | ESAGRS...VDR | A..A........ | 0.02 | 2 |
| EA... | F......KA.SA.T.A.G | .V........F....... | ...... | E.AAAN..E.DG | A..A........ | 0.02 | 2 |
| ..... | F......GA..K.M...E | ..PN.....NF....... | ...NDR | ............ | A..A........ | 0.02 | 2 |
| NT... | ................. | ................. | ...... | ............ | A..A........ | 0.02 | 2 |
| ..... | ................. | .........NF....... | R...D. | ............ | A..A........ | 0.02 | 2 |
| AA... | F.....A...H......L | .........NF....... | R..... | ............ | A..A........ | 0.02 | 2 |
| ..... | ................. | ..HG.....NF......T | R..DD. | E.TS.D..AY.D | A..A........ | 0.02 | 2 |
| SA... | ................. | .PPNG.....F......T | ...DDR | ............ | A..A........ | 0.02 | 2 |
| ..... | F................. | .V........F....... | ...... | ............ | GAKDR..NNA.H | 0.02 | 2 |
| ..... | F.....G.G.HA.T.G.R | TQPSQ....NF....... | ...DDR | ............ | A..A........ | 0.02 | 2 |
| ..... | F................. | .V........F....... | ...... | ............ | N.RDG..NRT.P | 0.02 | 2 |
| AT... | F.....GKG.NV.I.Q.G | TQ.TQ.....F....... | R..A.. | ESAK..DAA.DD | A..A........ | 0.02 | 2 |
| D.... | F.....AK..NV.M.G.R | TQ.TQ.....F....... | R...D. | .SGGA.D.E..N | A..A........ | 0.02 | 2 |
| ..... | ................. | ................. | ...... | .NGGRA.I...H | A..A........ | 0.02 | 2 |
| R.... | .........NP.M.E.R | TQYT.....NF......T | R...D. | ............ | A..A........ | 0.02 | 2 |
| ..... | ................. | .........F....... | ...... | ............ | KTRNT..AG..H | 0.02 | 2 |
| TA... | ................. | .........DF....... | R...D. | ............ | A..A........ | 0.02 | 2 |
| ..... | F................. | .V........F....... | ...... | ............ | GQRSH..DRN.E | 0.02 | 2 |
| GT... | F......GT.NM.L.Q.G | .KAS.....NF......T | E..DD. | ............ | A..A........ | 0.02 | 2 |
| ..... | ................. | ................. | ...D.. | ..GT.DD...DN | A..A........ | 0.02 | 2 |
| TA..T | F......TT.HN.L.G.R | T.PGG....NF....... | ...D.R | ............ | A..A........ | 0.02 | 2 |
| GA..T | ................. | ................. | ...DDR | ..A.RG.A..GH | A..A........ | 0.02 | 2 |
| ..... | ................. | ................. | ...D.. | .AGA..T..GR | A..A........ | 0.02 | 2 |
| ..... | F................. | ................. | E..NG. | ............ | ............ | 0.02 | 2 |
| ..... | F.....AST.PI.K.Q.K | TQASG....DF....... | ...D.. | EDTGAD....DS | A..A........ | 0.02 | 2 |
| RA... | ................. | .RPT......F....... | ...DDR | E.AGE...E..N | A..A........ | 0.02 | 2 |
| ..... | ................. | TQYT.....NF......T | R..AD. | ............ | A..A........ | 0.02 | 2 |
| ..... | F................. | .V........F....... | ...... | ............ | SBSP...FTE.P | 0.02 | 2 |
| TA..T | ................. | .........NF....... | R...D. | EDGGGS..E.GR | A..A........ | 0.02 | 2 |
| ..... | ................. | ................. | R..TG. | E.AGGS..AVDG | A..A........ | 0.02 | 2 |
| E.... | F.....AGA.NK.L...K | .V........F....S.. | ...... | ..TGAS..EV.N | A..A........ | 0.02 | 2 |
| ..... | ................. | ................. | ...D.. | E.TR.N.....Q | A..A........ | 0.02 | 2 |
| ..... | ................. | ................. | E..DDR | ............ | A..A........ | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| A.... | ................. | ................. | ....GR | ........... | A..A........ | 0.02 | 2 |
| TA... | F.....AAT.N..P.P.R | ..YN......F......T | ...D.R | ........... | A..A........ | 0.02 | 2 |
| ..... | ................. | ................. | E..NG. | EDTGGNDIA.DD | A..A........ | 0.02 | 2 |
| R.... | F.....DHT.R..M.G.R | .Q.DR.....F....... | ....D. | ..GRGSD.A.GD | A..A........ | 0.02 | 2 |
| ..... | F................ | .V........F....... | ...... | ........... | TRT....NNG.Q | 0.02 | 2 |
| GT... | ................. | .........NF....... | R...D. | EDAA...AAVDQ | A..A........ | 0.02 | 2 |
| ..... | F................ | .V........F....... | ...... | ........... | ARHSG..FNI.E | 0.02 | 2 |
| ..... | ................. | ................. | ...D.R | ESGKAS..A.GE | A..A........ | 0.02 | 2 |
| ..... | ................. | ................. | ...D.. | ........N... | A..A........ | 0.02 | 2 |
| ..... | ................. | ................. | ...DDR | E.......... | A..A........ | 0.02 | 2 |
| ..... | ................. | ................. | ...DG. | EDTA.G..E.G. | A..A........ | 0.02 | 2 |
| NA..T | ................. | .QPG.....NF....... | ...DD. | .DARAADA...Q | A..A........ | 0.02 | 2 |
| T.... | F.....AGA.NQ.N...V | .V........F....... | ...... | ..TGAS.A..DH | A..A........ | 0.02 | 2 |
| ..... | ................. | ..A......DF....... | E..ND. | ........... | ........... | 0.02 | 2 |
| ..... | F.....GKA.LQ.P.N.L | ................. | ...... | ........... | A..A........ | 0.02 | 2 |
| EA... | F.....SGA.LV.M.G.R | TQPNR.....F..P...T | ...DG. | ........... | A..A........ | 0.02 | 2 |
| GT... | ................. | .QPN......F......T | ...N.. | .DAGES..AF.Q | A..A........ | 0.02 | 2 |
| ..... | F................ | .V........F....... | ...... | ........... | AQRA....QG.E | 0.02 | 2 |
| ..... | F................ | .V........F....... | ...... | ........... | AQRAT..SNG.. | 0.02 | 2 |
| ..... | ................. | ................. | R...D. | ........... | ........... | 0.02 | 2 |
| ..... | ................. | ..A......DF....... | ...DG. | .DASGS.TAY.S | A..A........ | 0.02 | 2 |
| NA... | F.....AET..A.T...K | .QYDH....NF..P...T | R.... | ........... | A..A........ | 0.02 | 2 |
| TA... | F.....NKT.HL.T.A.R | TQASG.....F....... | R...D. | E.ATA...E.DD | A..A........ | 0.02 | 2 |
| ..... | ................. | ................. | ...D.. | .NASEN...FDR | A..A........ | 0.02 | 2 |
| ....T | F.....DNT.SK.L...K | .Q.G......F....... | R...D. | E.GSAND.EFDG | A..A........ | 0.02 | 2 |
| E.... | F.....STG.SV.M.T.L | ................. | ...DD. | ........... | ........... | 0.02 | 2 |
| ..... | ................. | ................. | E..AD. | ENAGASDIA.DH | A..A........ | 0.02 | 2 |
| GA... | ................. | .Q.DR.....F....... | ....D. | E.GTAN..AVD. | A..A........ | 0.02 | 2 |
| ..... | ................. | ................. | R..AD. | .NGG.ND....Q | A..A........ | 0.02 | 2 |
| ..... | F................ | .V........F....... | ...... | ........... | GPRNG..FGG.T | 0.02 | 2 |
| GT... | F.....DRG.S..T.A.S | ..DGE....DF....... | ...... | ........... | ........... | 0.02 | 2 |
| ..... | ................. | ................. | G..DDR | E.GGAA..EVDS | A..A........ | 0.02 | 2 |
| ..... | ................. | ...TG....NF....... | R..AD. | EDAKGG.....R | A..A........ | 0.02 | 2 |
| AT... | F.....AT..IA.K.Q.R | ..P.E....NF......T | ...DDR | ........... | A..A........ | 0.02 | 2 |
| ..... | ................. | ................. | ...DDR | ..ASE...E.D. | A..A........ | 0.02 | 2 |
| G...T | F................ | ................. | ...... | ........... | A..A........ | 0.02 | 2 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F................. | .V........F....... | ...... | ............ | NRRAT..ST..T | 0.02 | 2 |
| ..... | F................. | .V........F....... | ...... | ............ | GPRS...YSM.T | 0.02 | 2 |
| ..... | .................. | .................. | ...N.. | E..GAND.A... | A..A........ | 0.02 | 2 |
| T.... | F.....ANG.HL.K.K.S | .KPSE....DF......T | ...... | E.TD.A....DG | A..A........ | 0.02 | 2 |
| KA... | F.....GG..NK.M.... | .QPSE....DF....... | R..D.. | ............ | A..A........ | 0.02 | 2 |
| ..... | .................. | .................. | ...NDR | ..A.GD...VDH | A..A........ | 0.02 | 2 |
| ..... | .................. | .................. | ...D.R | .DATA..A.Y.H | A..A........ | 0.02 | 2 |
| GA..T | F......AG.NP.P.D.R | .QAS.....NF......T | ...... | ............ | A..A........ | 0.02 | 2 |
| SA... | F.....AQT.LA.I.K.K | TQ..H....NF....... | R..DD. | ESGR.GDA.F.E | A..A........ | 0.02 | 2 |
| ..... | .................. | .QDTQ.....F....... | ...DDR | ..ATRD.T...GH | A..A........ | 0.02 | 2 |
| ..... | .................. | .................. | ...... | EN.TR.DAA.DE | A..A........ | 0.02 | 2 |
| ..... | .................. | .................. | ...D.R | ............ | ............ | 0.02 | 2 |
| T.... | .................. | .QPNE....DF....... | G..ND. | .NGAESDIE.DG | A..A........ | 0.02 | 2 |
| RA... | F.....GKA.SE.N...L | .QPG.....NF....... | ...DDR | ............ | A..A........ | 0.02 | 2 |
| ..... | F................. | .V........F....... | ...... | ............ | GPRGR..DSE.H | 0.02 | 2 |
| TT..T | C................. | .................. | ...... | ............ | ............ | 0.02 | 2 |
| DT... | F.....SST.HI.I.T.G | .Q.S......F....... | E..ND. | ..AAE.D....N | A..A........ | 0.02 | 2 |
| ..... | .................. | .................. | G..DG. | .NGSAN..AFGQ | A..A........ | 0.02 | 2 |
| ..... | F................. | .................. | ...DDR | E.GRAADAAF.E | A..A........ | 0.02 | 2 |
| ..... | F.....NGG.NV.N.K.G | .QDT.....DF....... | ...DDR | ............ | A..A........ | 0.02 | 2 |
| ..... | .................. | .PPNG.....F......T | ...DDR | .S.......... | A..A........ | 0.02 | 2 |
| ..... | F................. | .V........F....... | ...... | ............ | TERTG..FDE.D | 0.02 | 2 |
| ..... | .................. | .................. | ...... | .STAAG...VDG | A..A........ | 0.02 | 2 |
| ..... | F................. | .V........F....... | ...... | ............ | APRGN..VTN.T | 0.02 | 2 |
| ..... | .................. | .........F....... | ...D.. | ENGKN..T.VGG | A..A........ | 0.02 | 2 |
| ..... | .................. | .........NF....... | ...DD. | ..ASE...E.D. | A..A........ | 0.02 | 2 |
| D...T | .................. | .................. | ...... | ..TTGA..AY.D | ............ | 0.02 | 2 |
| .A... | .................. | .................. | ....D. | ............ | A..A........ | 0.02 | 2 |
| .A... | F.....GQ..LN.L.D.R | .RPT......F..P...T | ...ND. | E.AG..D.A.GR | A..A........ | 0.02 | 2 |
| SA... | F.....DTG.PA.L.T.K | TQ.TG....DF....... | R..DD. | ..AAE.D....N | A..A........ | 0.02 | 2 |
| ..... | F................. | .V........F....... | ...... | ............ | EAKAR..FQ..H | 0.02 | 2 |
| ..... | .................. | .................. | ...DDR | EDGKGN..AF.. | A..A........ | 0.02 | 2 |
| ..... | .................. | .........DF....... | R...D. | ..GAEN..EF.R | A..A........ | 0.02 | 2 |
| E.... | .................. | ..A......DF....... | E..ND. | ............ | ............ | 0.02 | 2 |
| .A... | F.....SA..RA.....R | .................. | ...... | E..G.SDAA.GD | A..A........ | 0.02 | 2 |
| ..... | .................. | .................. | G..D.R | ..AGT.D.EYGQ | A..A........ | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| RA... | ................. | ..AGR.....F......T | R...D. | .......... | A..A........ | 0.02 | 2 |
| .A... | ................. | ................. | R..DD. | .......... | A..A........ | 0.02 | 2 |
| S...T | F.....G.G.IN.L...V | .V........F....... | ...... | ENGGGGD.A.GD | A..A........ | 0.02 | 2 |
| ..... | ................. | .Q.......DF....... | ...AD. | .NATG....VGS | A..A........ | 0.02 | 2 |
| GT..T | F.----ARG.IA.K.E.R | .QD.E.....F..P.... | ...... | ..AG.DDIA.DN | A..A........ | 0.02 | 2 |
| D...T | F............K.S | ................. | ...... | E.AAGND.EFDQ | .......... | 0.02 | 2 |
| ..... | ................. | .V........F....... | ...... | .......... | GTRG...VQS.E | 0.02 | 2 |
| A.... | F.....SN..PL.K.T.. | ................. | G..A.R | E.AG..D.A.GR | A..A........ | 0.02 | 2 |
| ..... | ................. | ........F....... | R..A.. | .......... | A..A........ | 0.02 | 2 |
| G...T | F.....DAA.HV.P...L | .QDGG....DF....... | ...D.R | .......... | A..A........ | 0.02 | 2 |
| T...T | F....DS..RA.P.A.S | ................. | ...... | .......... | A..A........ | 0.02 | 2 |
| ..... | F.....SS..SL.K.H.E | ........NF....... | R...D. | .......... | A..A........ | 0.02 | 2 |
| ..... | ................. | ................. | R..NG. | .S.G.S.IA..G | A..A........ | 0.02 | 2 |
| .A... | ................. | TQP.R....NF......T | E..DG. | ESAGRS...VDR | A..A........ | 0.02 | 2 |
| ..... | F................ | .V........F....... | ...... | .......... | TAQA...AP..T | 0.02 | 2 |
| ..... | ................. | ................T | G..KD. | .......... | A..A........ | 0.02 | 2 |
| DA... | F.....AEG.LK.M.H.L | ..DGE....DF....... | ...... | .......... | .......... | 0.02 | 2 |
| .A... | F.....ATT.NV.T.K.S | .KYT.....NF......T | R...D. | .......... | A..A........ | 0.02 | 2 |
| ..... | F................ | .V........F....... | ...... | .......... | E.RSA..VNT.P | 0.02 | 2 |
| E.... | F.....NKT.HL.T.A.R | ................. | ...... | ESTSTA..E... | A..A........ | 0.02 | 2 |
| ..... | F.....ART.P..M.A.N | .V........F....... | ...... | .......... | A..A........ | 0.02 | 2 |
| EA..T | F.....GA..SV.K.T.R | ........NF....... | R...D. | ES.SG.DIA.GE | A..A........ | 0.02 | 2 |
| E.... | F.....AGA.NQ.N...V | ..DD.....DF....... | ...DG. | E.ARGADI..GD | A..A........ | 0.02 | 2 |
| AT... | F.....AT..IA.K.Q.R | ................. | R...D. | ...AAS.A.VGQ | A..A........ | 0.02 | 2 |
| NA..T | F.....SA..RA.....R | .QDT.....F....... | R...DD. | .N.AGNDAAVDE | A..A........ | 0.02 | 2 |
| .A... | F.....DAG.LL.T.A.K | .Q.DR.....F....... | ....D. | .......... | A..A........ | 0.02 | 2 |
| ..... | F................ | .V........F....... | ...... | .......... | KPKDA...EA.A | 0.02 | 2 |
| ..... | F................ | .V........F....... | ...... | .......... | GD.DR..SEE.Q | 0.02 | 2 |
| ..... | ................. | ................. | R..DD. | EDGKGN..AF.. | A..A........ | 0.02 | 2 |
| A.... | F......KT.NV.K.T.K | TQASH.....F....... | E..TD. | ..TGGNDAE.DD | A..A........ | 0.02 | 2 |
| ..... | F................ | T..SE...DF....... | E...G. | .......... | A..A........ | 0.02 | 2 |
| RA... | F.....GEA.PL.L.N.R | ..DD.....DF....... | R...D. | .NTGGG.....H | A..A........ | 0.02 | 2 |
| TA... | F......GT.NM.L.Q.G | .Q.S......F....... | ....D. | .......... | A..A........ | 0.02 | 2 |
| DT..T | F......GT.NM.L.Q.G | .Q.S......F....... | ....D. | .......... | .......... | 0.02 | 2 |
| ..... | ................. | ...DG....DF......T | ...DDR | .DARRN.AE.GS | A..A........ | 0.02 | 2 |
| ..... | ................. | ................. | ...D.R | .D.GG.....GH | A..A........ | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | .................. | ...DGR | .DTG.GD.A..H | A..A........ | 0.02 | 2 |
| TA... | .................. | .................T | ...KDR | ............ | A..A........ | 0.02 | 2 |
| ..... | .................. | ..........F....... | ...DD. | .SAKAA.AA.DE | A..A........ | 0.02 | 2 |
| AT..T | F.....DTA.HV.K.G.G | .........DF....... | G..AD. | ............ | A..A........ | 0.02 | 2 |
| A.... | F.....AGA.NK.L...K | T..NE...DF.......T | ...D.. | ............ | A..A........ | 0.02 | 2 |
| ..... | .................. | .................. | ...DDR | ESAGGD..EV.R | A..A........ | 0.02 | 2 |
| ..... | .................. | .V........F....... | ...... | EDAGT...AFD. | A..A........ | 0.02 | 2 |
| ..... | .................. | .................. | ...N.. | E.GGG...E.GE | A..A........ | 0.02 | 2 |
| NA... | .................. | .................. | ...NGR | ............ | A..A........ | 0.02 | 2 |
| R.... | F................. | .QPTR.....F....... | E..NG. | ............ | A..A........ | 0.02 | 2 |
| TA... | F.....AGA.NQ.N...V | TQPTE....DF......T | ...D.R | ............ | A..A........ | 0.02 | 2 |
| HT... | F.....AEG.LK.M.H.L | ..DGE....DF....... | ...... | ............ | ............ | 0.02 | 2 |
| G.... | .................. | .................. | ...NG. | ............ | ............ | 0.02 | 2 |
| ..... | .................. | .................. | E..AD. | E.GRAADAAF.E | A..A........ | 0.02 | 2 |
| ..... | F................. | .V........F....... | ...... | ............ | SRRDA....G.E | 0.02 | 2 |
| ..... | F................. | .V........F....... | ...... | ............ | G.KSG..F.G.D | 0.02 | 2 |
| D.... | .................. | .........DF......T | ...DG. | ENTNGSD.AY.S | A..A........ | 0.02 | 2 |
| ....T | F.....ART.P..M.A.N | .V........F....... | ...... | ............ | A..A........ | 0.02 | 2 |
| G.... | F.....A...ND.T...K | ..PN.....NF....... | ...NDR | ............ | A..A........ | 0.02 | 2 |
| ..... | F......GT.NM.L.Q.G | .Q.S......F....... | ....D. | ............ | AR.AR..SR..D | 0.02 | 2 |
| T.... | F.....AEG.NI.L.K.R | .Q.DR.....F....... | ...DDR | ..AN.ADIAYDH | A..A........ | 0.02 | 2 |
| HT... | F.....ARA.P..L.G.V | .V........F....... | ...... | ESAGTN.....R | A..A........ | 0.02 | 2 |
| GT... | .................. | .................. | R..DD. | ..AG..D.A.GR | A..A........ | 0.02 | 2 |
| AA... | F.....DRG.HA.T...G | .................. | ...... | ............ | A..A........ | 0.02 | 2 |
| ..... | F................. | .KDSR....DF....... | ...DDR | .DATA..A.Y.H | A..A........ | 0.02 | 2 |
| DT... | .................. | .PPNG.....F......T | ...DDR | E.ATRA..A.DE | A..A........ | 0.02 | 2 |
| ..... | F.....AAT.N..P.P.R | .................. | R..N.. | .DGNGSDI.Y.E | A..A........ | 0.02 | 2 |
| DT... | F.....ARG.I..T.A.K | ..DGE.....F......T | R...D. | .S.G..D..FGG | A..A........ | 0.02 | 2 |
| ..... | F................. | .V........F....... | ...... | ............ | G.KGP..DKN.D | 0.02 | 2 |
| ..... | .................. | .................. | ...... | .DAKG..I.FDG | A..A........ | 0.02 | 2 |
| ..... | .................. | .................. | ...DDR | .DGGGAD.A.D. | A..A........ | 0.02 | 2 |
| ..... | .................. | ..........F......T | R..N.. | ............ | A..A........ | 0.02 | 2 |
| A...T | F.....G.G.HM.M.G.R | ..A......DF....... | ...DG. | EDAA.A.AE..Q | A..A........ | 0.02 | 2 |
| TA... | F.....NE..SD.H...K | ..DGE...DF....... | ...... | ............ | A..A........ | 0.02 | 2 |
| ..... | .................. | .........NF......T | R..TG. | .DGG.....Y.Q | A..A........ | 0.02 | 2 |
| ..... | F................. | .V........F....... | ...... | ............ | TPRNR..ANG.D | 0.02 | 2 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | ................. | .........NF....... | ...AGR | ............ | A..A........ | 0.02 | 2 |
| ..... | ................. | ................. | ...D.R | .CTG.D..A.GG | A..A........ | 0.02 | 2 |
| ..... | F................ | .V.......F....... | ...... | ............ | RTP....AQ..D | 0.02 | 2 |
| RT... | F................ | TKDDR....DF....... | ...DDR | ............ | A..A........ | 0.02 | 2 |
| RT... | F.....NN..SA.N...R | T.P......DF....... | ...D.. | ES.AGGDAAFDQ | A..A........ | 0.02 | 2 |
| ..... | ................. | .................T | ...A.. | ............ | A..A........ | 0.02 | 2 |
| ..... | ................. | ..A....DF....... | ...DG. | ............ |  | 0.02 | 2 |
| TA... | F.....AA..RM.P.G.. | ..ATR....DF....... | E..N.. | ............ | A..A........ | 0.02 | 2 |
| ..... | ................. | .........F......T | ....GR | .NG..G.I...G | A..A........ | 0.02 | 2 |
| E.... | F................ | .V.......F....... | ...... | ............ | DRRSS..FEG.D | 0.02 | 2 |
| ..... | F.....STA..Q.H.Q.L | ..YN......F......T | ...D.R | .DAKRD.AAFDQ | A..A........ | 0.02 | 2 |
| DT... | F................ | T.HGR....NF......T | ....GR | ............ | A..A........ | 0.02 | 2 |
| ..... | F................ | .V........F....... | ...... | ............ | G.HTN..FEG.A | 0.02 | 2 |
| ..... | F................ | .V........F....... | ...... | ............ | AARTD..AK..H | 0.02 | 2 |
| ..... | F.....GQG.IA.....K | .QAS.....NF......T | ...DDR | ............ | A..A........ | 0.02 | 2 |
| RA... | F.....GKT.SL...S.K | .QAS......F....... | ...... | EDGSRND..... | A..A........ | 0.02 | 2 |
| ..... | F................ | .V........F....... | ...... | ............ | .QSNA..STR.D | 0.02 | 2 |
| A...T | F.....AQ...A.L.... | .V........F....... | ...... | ............ | A..A........ | 0.02 | 2 |
| A...T | F.....DN...L.I.N.R | T.PTG....DF....... | ...DDR | ...GAS..AYGE | A..A........ | 0.02 | 2 |
| ..... | ................. | ................. | ...... | ESTK..D.A.GD | A..A........ | 0.02 | 2 |
| A.... | F.....ATG.NV.T.G.R | ..DGE....DF....... | ...... | ENGTASD.AF.E | A..A........ | 0.02 | 2 |
| ..... | ................. | .........DF....... | E..AD. | .DTA.G.AAVDQ | A..A........ | 0.02 | 2 |
| ET..T | F................ | ..PN.....NF....... | E..KD. | ............ | A..A........ | 0.02 | 2 |
| ..... | F.....SA..SM.M.T.K | .PHD.....DF..P.... | E..DD. | .SAGRGDAE.GQ | A..A........ | 0.02 | 2 |
| ..... | ................. | ................. | ...DDR | ESTKAA.T..DH | A..A........ | 0.02 | 2 |
| ..... | F.....NGG..K.L...G | .QP.G.....F....... | ...... | ............ | A..A........ | 0.02 | 2 |
| ..... | ......DRG.PI.L.A.R | TQPT......F......T | ...DG. | ............ | A..A........ | 0.02 | 2 |
| AT..T | .................K | ..HGE....DF....... | ...DD. | ..AGTSD.AFGN | A..A........ | 0.02 | 2 |
| ..... | F................ | .V........F....... | ...... | ............ | GARG...S.T.T | 0.02 | 2 |
| R.... | F.....DA..IA.L.K.R | .QDT.....NF....... | ...DDR | EDAT..D.E.G. | A..A........ | 0.02 | 2 |
| ..... | ................. | ................. | E..ND. | E.TR.N.....Q | A..A........ | 0.02 | 2 |
| ..... | ................. | .KYT.....NF....... | ...NDR | ED.R.S.A...G | A..A........ | 0.02 | 2 |
| ..... | ................. | .........DF....... | R..NG. | ...G.S..AFGD | A..A........ | 0.02 | 2 |
| A...T | ................. | ................. | ...... | EDAGRND.A.D. | A..A........ | 0.02 | 2 |
| ..... | ................. | ................. | R...D. | ESTA.G.IEF.G | A..A........ | 0.02 | 2 |
| GA... | F.....AGG.HV.K.K.V | .KDT......F......T | ...DD. | ............ | A..A........ | 0.02 | 2 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| DT... | F.....R..$..T...N | ................. | ...... | ........... | A..A........ | 0.02 | 2 |
| ..... | ................. | ................. | ...... | ESGGTD....DR | A..A........ | 0.02 | 2 |
| NA... | ................. | .PPNG.....F......T | ...DDR | E.TR.N.....Q | A..A........ | 0.02 | 2 |
| H.... | F.....SGT.NM.K.T.E | ................. | ...... | ........... | A..A........ | 0.02 | 2 |
| ..... | .....GRT.ND.L.Q.R | .........NF....... | R...D. | E.TR.N.....Q | A..A........ | 0.02 | 2 |
| ..... | F................ | .V........F....... | ...... | ........... | .DRDT..D.I.Q | 0.02 | 2 |
| ..... | ................. | ................. | G..K.. | .SADGSD...DR | A..A........ | 0.02 | 2 |
| GA... | F................ | .V........F....... | ...... | ........... | G.RSG..VR..H | 0.02 | 2 |
| SA... | F......RT.IK.P.D.K | .QPN......F......T | G..N.. | ..ATGSD.A..H | A..A........ | 0.02 | 2 |
| TT..T | ................. | .V............... | ...... | ........... | A..A........ | 0.02 | 2 |
| ..... | F.....STG.SV.M.T.L | .QPSQ....NF....... | ...D.. | .DAG.A.I..DG | A..A........ | 0.02 | 2 |
| .A... | F.....SNG.RE.L...K | TKDDR....DF....... | ...DDR | ........... | A..A........ | 0.02 | 2 |
| ..... | F................ | ..........F......T | ...DDR | ........... | A..A........ | 0.02 | 2 |
| ..... | ................. | ................. | E..KG. | ENA.GAD..... | A..A........ | 0.02 | 2 |
| ..... | ................. | ................. | R..DD. | E.TS.D..AFDQ | A..A........ | 0.02 | 2 |
| SA... | F.....NGG.NV.N.K.G | ..YN......F......T | ...D.R | ........... | A..A........ | 0.02 | 2 |
| A.... | ................. | ................. | G..DG. | ........... | A..A........ | 0.02 | 2 |
| ..... | ................. | ................. | ...D.. | E.GD.A.A..DD | A..A........ | 0.02 | 2 |
| ..... | ................. | ................. | ...... | E.GGA.D.E..G | A..A........ | 0.02 | 2 |
| GA... | ................. | ..AGR....DF......T | R..D.. | .D......... | A..A........ | 0.02 | 2 |
| ..... | ................. | ................. | G..KGR | .DAG.S.A..DR | A..A........ | 0.02 | 2 |
| ..... | ................. | ................. | E..AD. | E.ATGA.....G | A..A........ | 0.02 | 2 |
| E.... | F.....GKG.ND.T.N.G | T.AG.....NF......T | ...D.R | ........... | A..A........ | 0.02 | 2 |
| ..... | ................. | ...........F...... | G..D.R | ..ASE...E.D. | A..A........ | 0.02 | 2 |
| AA... | F.....AGA.SL.....R | T.ANE.....F....... | ...D.. | ........... | A..A........ | 0.02 | 2 |
| RT... | F................ | ................. | ...... | ..GGGN.IE..R | ........... | 0.02 | 2 |
| AA... | F.....NR..NK.I.E.S | T..NE.....F......T | ...DDR | E.AGAND.AV.H | A..A........ | 0.02 | 2 |
| ..... | F.....NAT.RP.K.A.R | .........NF....... | R...D. | .DGARDDAA..D | A..A........ | 0.02 | 2 |
| TT... | F.....AEG.LK.M.H.L | ..DGE....DF....... | ...... | ........... | ........... | 0.02 | 2 |
| DT... | F......N..IL.T.T.R | .QPSQ....NF....... | G...GR | ........... | A..A........ | 0.02 | 2 |
| ..... | ................. | ................. | G..... | .DAGTA...FGG | A..A........ | 0.02 | 2 |
| ..... | ................. | ................. | R...D. | .NTAGND....R | A..A........ | 0.02 | 2 |
| RT... | ................. | ..AGR....DF......T | R..D.. | .SAKAA.AA.DE | A..A........ | 0.02 | 2 |
| ..... | ................. | ................. | ...... | .S.GAD..EV.G | A..A........ | 0.02 | 2 |
| ..... | ................. | ................. | ...D.R | ESTGEN...V.R | A..A........ | 0.02 | 2 |
| ..... | ................. | .QDGG.....F......T | ...DD. | ........... | A..A........ | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F.....NGG.IM.L.E.R | T.P......DF....... | R...D. | ........... | A..A........ | 0.02 | 2 |
| RA... | ................. | ..DGE....DF....... | ...... | E.GSR..AAVGD | A..A........ | 0.02 | 2 |
| ..... | ................. | ..A......DF..P.... | ...DD. | E.TTGND..V.S | A..A........ | 0.02 | 2 |
| ..... | F................ | .Q.GQ....DF....... | ....G. | .STTGA...V.Q | A..A........ | 0.02 | 2 |
| ..... | ................. | ................. | ...... | EDAGRND.A.D. | A..A........ | 0.02 | 2 |
| ..... | ................. | ................. | ...... | EDARGA...VGN | A..A........ | 0.02 | 2 |
| SA... | F......TG.IL...T.R | .QAS.....NF......T | ....GR | .DAGA.D.EVDE | ........... | 0.02 | 2 |
| ..... | ................. | .KPSE....DF......T | R...DR | E.ASTA..A.GQ | A..A........ | 0.02 | 2 |
| ..... | F................ | ................. | ...... | ..AG..DIAF.G | A..A........ | 0.02 | 2 |
| ..... | F................ | .V........F....... | ...... | ........... | GHRDG..FRA.Q | 0.02 | 2 |
| ..... | F................ | .V........F....... | ...... | ........... | KPRDG..DRI.. | 0.02 | 2 |
| ..... | ................. | ..........F......T | ...D.. | E.ATRGDTE.DR | A..A........ | 0.02 | 2 |
| NA..T | ................. | ..YN......F......T | ...D.R | ........... | A..A........ | 0.02 | 2 |
| NA... | F.....ATT.NV.T.K.S | ..HG.....NF......T | ...D.. | ........... | A..A........ | 0.02 | 2 |
| EA... | F................ | .V........F....... | ...... | ........... | SHRGE..FDV.T | 0.02 | 2 |
| GT... | F.....AEG.LK.M.H.L | ..DGE....DF....... | ...... | ........DR | ........... | 0.02 | 2 |
| RA... | ................. | TQ.TG....DF....... | ...... | EDGGGS..E.GR | A..A........ | 0.02 | 2 |
| ..... | F................ | .V........F....... | ...... | ........... | GPRD...I.E.T | 0.02 | 2 |
| ..... | .....NKT.HL.T.A.R | .........NF....... | ....G. | ..TK...AE..D | A..A........ | 0.02 | 2 |
| .A... | F.....GQ...M.M...H | ..A.R....DF....... | ...... | ........... | A..A........ | 0.02 | 2 |
| ..... | F................ | .V........F....... | ...... | ........... | NAKAA..VGE.H | 0.02 | 2 |
| GA... | ................. | ...T.....NF......T | ...DDR | .SAKAA.AA.DE | A..A........ | 0.02 | 2 |
| ..... | F................ | .V........F....... | ...... | ........... | TDRNH..FDE.. | 0.02 | 2 |
| E.... | F................ | .V........F....... | E..ND. | ........... | A..A........ | 0.02 | 2 |
| G.... | F.....GGG.L..N.P.K | .V........F....... | ...... | E.ATR.DT.YDQ | A..A........ | 0.02 | 2 |
| ..... | F.....NGG.HV.....L | ....E....DF....... | R...D. | ........... | A..A........ | 0.02 | 2 |
| ..... | ................. | TQ.TG....DF....... | ...DDR | ESG.AS...VDG | A..A........ | 0.02 | 2 |
| A.... | ................. | .QD.E....F..P..... | ...DG. | ........... | A..A........ | 0.02 | 2 |
| ..... | F................ | .V........F....... | ...... | ........... | A.RS...NR..D | 0.02 | 2 |
| ..... | ................. | .QPSQ....NF....... | ...D.. | ........... | ..AGAS...FDR | 0.02 | 2 |
| ..... | ................. | ..........F....... | ...... | ........... | ........... | 0.02 | 2 |
| GT... | F.....NGG.RP...D.G | .V........F....... | ...... | ........... | A..A........ | 0.02 | 2 |
| ..... | F.....SGT.SQ.K.E.. | .Q.......DF....... | ...AD. | E.AA.G..AF.S | A..A........ | 0.02 | 2 |
| GT... | ................. | ..........F....... | R..... | ..AGRG.TA.DD | A..A........ | 0.02 | 2 |
| ..... | ................. | .V........F....... | ...... | ........... | A.RTA..DTM.D | 0.02 | 2 |
| ..... | F.....AQ..RK.T.E.. | T.PNE....DF....... | R..... | ........... | A..A........ | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| TA... | F.....NR..IK.P...G | ..DGE....DF....... | ...... | .DAAGS..A.DE | A..A........ | 0.02 | 2 |
| EA... | .................. | .Q.S......F....... | E..N.. | .SAGAN..E..S | ............ | 0.02 | 2 |
| E.... | F.....NHA.LA.L.T.E | ..DGE....DF....... | ...... | ESGKAS..A.GE | A..A........ | 0.02 | 2 |
| GT... | F......GT.NM.L.Q.G | .Q.S......F....... | ....D. | ............ | ............ | 0.02 | 2 |
| E.... | F......G..NQ.N.A.G | TKAT.....NF......T | ...NDR | ............ | A..A........ | 0.02 | 2 |
| TA... | .................. | .................. | ...D.R | EDAGRGD...GN | A..A........ | 0.02 | 2 |
| ..... | .................. | .KYT.....DF......T | E..ND. | E.AGRDD...DR | A..A........ | 0.02 | 2 |
| ..... | .................. | .................. | ...AGR | E.TGTG..E.DS | A..A........ | 0.02 | 2 |
| ..... | .................. | ..AGR.....F......T | R..D.. | ............ | A..A........ | 0.02 | 2 |
| A.... | F.....GG..NK.M.... | .QPSE....DF....... | R..ND. | ............ | A..A........ | 0.02 | 2 |
| G...T | F.....GTG..P.T.D.R | .QPSQ....NF....... | ...D.R | E.AGTNDI...R | A..A........ | 0.02 | 2 |
| T.... | .................. | .KDT......F......T | ...DD. | ESGA.A.AAV.H | A..A........ | 0.02 | 2 |
| ..... | .................. | .................. | ...... | ..ATAD..AFDG | A..A........ | 0.02 | 2 |
| ..... | .................. | .................T | ...... | ..AS.N.IA.GD | A..A........ | 0.02 | 2 |
| D.... | F.....NNA..K...K.. | .QANH.....F......T | R..DD. | ............ | A..A........ | 0.02 | 2 |
| D...T | .................. | .................. | ...A.. | .NTGGG....DG | A..A........ | 0.02 | 2 |
| ..... | .................. | .V........F....... | ...... | .S.G.S.IA..G | A..A........ | 0.02 | 2 |
| A...T | F.....AQ...A.L.... | T.PGG....NF....... | R...D. | ............ | A..A........ | 0.02 | 2 |
| ..... | F................. | .V........F....... | ...... | ............ | .P.TS..FNE.D | 0.02 | 2 |
| NT..T | F.....S.T..I.K.N.M | .V........F....... | ...... | E.T..S..A..R | A..A........ | 0.02 | 2 |
| AA... | F.....GTG..P.T.D.R | T.PGG....NF....... | ...DD. | ............ | A..A........ | 0.02 | 2 |
| .T... | ......GRG.NQ.K.E.H | ..DGE....DF....... | ...... | ............ | ............ | 0.02 | 2 |
| ..... | .................. | .................. | R..AD. | ..AG.N.AA.GQ | A..A........ | 0.02 | 2 |
| NA... | .................. | .V........F....... | ...... | ............ | ASSNH..AKG.D | 0.02 | 2 |
| A.... | F......GG.NA.H.Q.R | ..DGE....DF......T | E..NG. | ............ | A..A........ | 0.02 | 2 |
| RT... | .................. | .Q.DR.....F....... | ....D. | .SGTRA..A.GE | A..A........ | 0.02 | 2 |
| ..... | F................. | .V........F....... | ...... | ............ | T.RAA...GE.H | 0.02 | 2 |
| TA..T | F.....SG..IK.K.D.R | .PPNG.....F......T | ...DDR | ............ | A..A........ | 0.02 | 2 |
| RA... | F.....DD..IH.K.K.K | .QPN......F......T | ...N.. | ENGGGA.I..GQ | A..A........ | 0.02 | 2 |
| ..... | F.....GQG.IA.....K | .Q......DF....... | ...AD. | .NTGGN.T..DN | A..A........ | 0.02 | 2 |
| .A... | .................. | .................. | E..NG. | E....ND.EF.Q | ............ | 0.02 | 2 |
| GA... | ............H...R | .QANH.....F......T | ...D.. | ENG.AG....DQ | A..A........ | 0.02 | 2 |
| ..... | .................. | .................. | ....D. | .D.GRA...F.. | A..A........ | 0.02 | 2 |
| ..... | .................. | .................. | ....D. | ENTTGNDAE.GQ | A..A........ | 0.02 | 2 |
| ..... | ......STA..Q.H...G | ...GG.....F..P...T | G..ND. | ............ | A..A........ | 0.02 | 2 |
| ..... | F................. | .V........F....... | R..AD. | ............ | A..A........ | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................ | .................. | ...A.. | ..GTGG.T...G | A..A........ | 0.02 | 2 |
| TT... | F.....ASA.S..T.T.G | ..DGE....DF....... | ...... | ............ | A..A........ | 0.02 | 2 |
| N.... | ................ | ..DGE....DF....... | ...... | E.TGRA..A..G | A..A........ | 0.02 | 2 |
| H.... | F......GA.NM.L.Q.G | .Q.S......F....... | ....D. | ............ | ............ | 0.02 | 2 |
| ..... | F................ | .V........F....... | T..... | ............ | .DRDE.VGG... | 0.02 | 2 |
| ..... | ................ | .................. | ...D.. | ED.TEGD...G. | A..A........ | 0.02 | 2 |
| ..... | ................ | .................. | ...D.. | ..TGGS.A.V.. | A..A........ | 0.02 | 2 |
| ..... | ......AST.IN.L.T.. | .................. | ...... | ............ | ............ | 0.02 | 2 |
| S.... | F.....DGA.R..P.A.K | ........NF....... | R...D | ............ | A..A........ | 0.02 | 2 |
| ..... | F.....SRA.SK.N.A.H | .QDT.....DF....... | ...DDR | ...G.S..AFGD | A..A........ | 0.02 | 2 |
| GT... | ................ | .................T | ...... | ............ | A..A........ | 0.02 | 2 |
| ..... | F.....DA..IA.L.K.R | .PPNG.....F......T | ...DDR | ............ | A..A........ | 0.02 | 2 |
| ..... | ................ | ..........F....... | R..AD. | .NAR.A.I..GE | A..A........ | 0.02 | 2 |
| TA... | F.....GGA.ID.I.Q.L | ..PN.....NF....... | ...NDR | ............ | A..A........ | 0.02 | 2 |
| ..... | ................ | .................. | ...DDR | E.ATRA.IE.DD | A..A........ | 0.02 | 2 |
| NT... | ................ | .PPNG.....F......T | ...DDR | ............ | A..A........ | 0.02 | 2 |
| TA... | F......A.G..V.T.H.R | TKDT.....NF....... | ...ND. | .SAARNDTAY.N | A..A........ | 0.02 | 2 |
| ..... | ................ | .................. | R..DD. | EDGGA.D.AV.N | A..A........ | 0.02 | 2 |
| E.... | F.....G.G.HM.M.G.R | ..A......DF....... | ...DG. | EDAA.A.AE..Q | A..A........ | 0.02 | 2 |
| G.... | ................ | .................. | ...... | .STSRGD...GG | A..A........ | 0.02 | 2 |
| A.... | F.....SQT.IH.K.T.R | TQ.TG....DF....... | ...D.R | E.GGANDT...G | A..A........ | 0.02 | 2 |
| ..... | ................ | .................T | ...DDR | ............ | A..A........ | 0.02 | 2 |
| D...T | ................ | ...GG....NF......T | ...... | EN.TR.DAA.DE | A..A........ | 0.02 | 2 |
| ..... | ................ | .................. | ...N.. | ..AKA.DTEV.Q | A..A........ | 0.02 | 2 |
| NT... | F.....NDG.PA.K.T.R | .Q.DR.....F....... | ....D. | ............ | A..A........ | 0.02 | 2 |
| ..... | ................ | .................. | R..DDR | ..AG.ND.EF.Q | A..A........ | 0.02 | 2 |
| A.... | F.....G.G.HM.M.G.R | ..A......DF....... | ...DG. | EDAA.A.AE..Q | A..A........ | 0.02 | 2 |
| ..... | ................ | .................. | E..A.R | ............ | A..A........ | 0.02 | 2 |
| SA... | F................ | .V........F....... | ...... | ............ | THRT...VRN.D | 0.02 | 2 |
| GA... | F.....AG..I..H.G.. | ..DGE....DF....... | ...... | E.TR.N.....Q | A..A........ | 0.02 | 2 |
| .A... | ................ | .KYT.....NF......T | ...D.R | ESATGD..E.GQ | A..A........ | 0.02 | 2 |
| ..... | F................ | ..........F....... | ...DDR | E..N...I..DR | A..A........ | 0.02 | 2 |
| D.... | ................ | .V........F....... | ...... | ............ | A..A........ | 0.02 | 2 |
| TT... | F.....SNG.P....T.R | ..DGE....DF....... | ...... | ............ | A..A........ | 0.02 | 2 |
| ..... | F................ | .V........F....... | ...... | ............ | TQHTP..AQE.E | 0.02 | 2 |
| DT... | F.....DTG.PA.L.T.K | .Q.DR.....F....... | ....D. | ............ | A..A........ | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | .QPN.....NF....... | G..NDR | .DGREN.A..DG | A..A........ | 0.02 | 2 |
| AA... | ................. | ..P.....DF....... | ...D.. | ENAGRGDI.... | A..A........ | 0.02 | 2 |
| R.... | F.....DA..IA.L.K.R | .PPNG.....F......T | ...DDR | ............ | A..A........ | 0.02 | 2 |
| ..... | ................. | ................T | ...DDR | .DGSGG.TE.DG | A..A........ | 0.02 | 2 |
| D.... | ................. | ..ADH....DF....... | R...D. | ED.A.G.T..DN | A..A........ | 0.02 | 2 |
| AT..T | ................. | ..AGR....DF......T | R..D. | ............ | A..A........ | 0.02 | 2 |
| ..... | F.....GQA.LV.K.E.M | .V........F....... | ...... | ............ | A..A........ | 0.02 | 2 |
| ..... | ................. | ..PN.....NF....... | E..N.. | ............ | A..A........ | 0.02 | 2 |
| ..... | ................. | ................. | ...DDR | E.A.AD.AAF.. | A..A........ | 0.02 | 2 |
| D...T | ................. | .QPN......F......T | ....D. | ES.NRD....GQ | A..A........ | 0.02 | 2 |
| RA... | F.....GGT.IV.K.G.K | .Q.DR....DF....... | ...DDR | ............ | GQKDR..ST..H | 0.02 | 2 |
| ..... | ................. | ................. | R..DD. | ............ | A..A........ | 0.02 | 2 |
| ..... | ................. | ................. | ...DD. | .DAG.S.A..DR | ............ | 0.02 | 2 |
| A...T | F.....DRG.PI.L.A.R | TQPT......F......T | ...DG. | ............ | A..A........ | 0.02 | 2 |
| GA... | ................. | .QPG.....NF....... | ...DD. | E.GGA.D.E..G | A..A........ | 0.02 | 2 |
| TA... | F.....DRG.S..T.A.S | ..DGE....DF....... | ...... | ............ | ............ | 0.02 | 2 |
| A.... | F.....AEG.LK.M.H.L | .KYT.....NF......T | E..TD. | .SAKAA.AA.DE | A..A........ | 0.02 | 2 |
| D.... | F.....SR...A.L.... | ..HG.....F......T | ...... | ............ | A..A........ | 0.02 | 2 |
| ..... | F................. | .V........F....... | ...... | ............ | GNKDP..DGV.A | 0.02 | 2 |
| .A... | F.....DRG.S..T.A.S | ..DGE....DF....... | G..DG. | ............ | ............ | 0.02 | 2 |
| E.... | F.....ASA.S..T.T.G | .QPG.....DF....... | ....D. | ...R.G.....E | A..A........ | 0.02 | 2 |
| A.... | ................. | ................. | ...ADR | ..AGAN...FGQ | A..A........ | 0.02 | 2 |
| ..... | F................. | ................. | R..AD. | E.TTG..IAVDD | A..A........ | 0.02 | 2 |
| TT... | F.....GAT.IN.M.K.L | T.P......DF....... | R...D. | ..TG.N.IAF.D | A..A........ | 0.02 | 2 |
| E.... | F.....NQG.RV.I.N.R | .PANG.....F....... | ...DDR | ..AT.DDA..DQ | A..A........ | 0.02 | 2 |
| ..... | F.....SG..SH.T.G.G | TQDGE....DF....... | ...DG. | ...SRDD...GG | A..A........ | 0.02 | 2 |
| ..... | F................. | .V........F....... | ...... | ............ | NAKTR..FTT.D | 0.02 | 2 |
| R.... | ................. | .Q.DR.....F....... | ...... | ES.SA..I..DR | A..A........ | 0.02 | 2 |
| GT... | ......ATT.NV.T.K.S | ................. | ...... | ............ | A..A........ | 0.02 | 2 |
| RT... | F.....NGG.NN.K.T.R | .........NF....... | R...D. | .DTG.GD.A..H | A..A........ | 0.02 | 2 |
| GT... | ................. | .QD.E.....F..P.... | ...... | ............ | ............ | 0.02 | 2 |
| ..... | ................. | ................. | G..DG. | ............ | STRAP..STN.D | 0.02 | 2 |
| D.... | ................. | ..HG.....NF......T | ...A.. | E..AGS.AA.DN | A..A........ | 0.02 | 2 |
| ..... | F................. | .V........F....... | ...... | ............ | S.SSG..FGG.E | 0.02 | 2 |
| EA... | F.....DAA.IK.T.Q.N | ..DGE....DF....... | ...... | E........... | GTQSR..DRG.. | 0.02 | 2 |
| NT..T | ................. | ................. | E..N.. | E.TGRA..A..G | A..A........ | 0.02 | 2 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | .................. | .................. | R..D.. | ............ | ............ | 0.02 | 2 |
| ..... | .................. | .................. | ...D.. | .SG.TN.T..D. | A..A........ | 0.02 | 2 |
| ..... | F.....ATT.NV.T.K.S | TKAT.....NF......T | ...... | .SAAAA.I.F.H | A..A........ | 0.02 | 2 |
| ..... | .................. | .................. | R..ND. | ............ | A..A........ | 0.02 | 2 |
| ..... | F......S..SA.I.K.K | T.ASH....DF...... | ...D.. | .DTGTGD...GG | A..A........ | 0.02 | 2 |
| SA... | F.....SNA.HP.I.E.. | .................. | ...... | ............ | A..A........ | 0.02 | 2 |
| ..... | .................. | .Q.GQ....DF...... | ....G. | ..TG.N.IAF.D | A..A........ | 0.02 | 2 |
| ..... | F................. | .V........F...... | ...... | ............ | SAKTA..FE... | 0.02 | 2 |
| ..... | .................. | .................. | .D.R | .NASEN.AA..D | A..A........ | 0.02 | 2 |
| E.... | F.........HK.P.N.G | .V........F...... | ...... | ............ | A..A........ | 0.02 | 2 |
| AA... | F.....NRG.S..T.A.S | ..DGE....DF...... | ...... | ............ | ............ | 0.02 | 2 |
| R.... | .................. | TQ.GG....NF...... | ...DDR | ...G.A..E.GR | A..A........ | 0.02 | 2 |
| TA... | F.....GS..NM.N.E.R | .Q.GQ....DF...... | ....G. | E.TAG.DI..D. | A..A........ | 0.02 | 2 |
| ..... | F.....NAG.LA...Q.R | .........NF...... | R...D. | ..GT..DAAY.E | A..A........ | 0.02 | 2 |
| G.... | F.....AHT..H.K.G.H | ..........F...... | ...... | ............ | .A.TP..FNI.D | 0.02 | 2 |
| ..... | F.....STA..Q.H.Q.L | .QHNQ.....F......T | ...N.. | ............ | A..A........ | 0.02 | 2 |
| ..... | F................. | .................. | R..DD. | ............ | ............ | 0.02 | 2 |
| ..... | .................. | .................. | ...DDR | EN.GTN.AE.DN | A..A........ | 0.02 | 2 |
| D.... | F.....SAA.NM.M.A.L | T.ANH....NF......T | R...D. | ............ | A..A........ | 0.01 | 1 |
| ..... | F.....DGT.SM.N.G.R | .KPDQ.....F...... | ...DG. | ..ATGSD.A..H | A..A........ | 0.01 | 1 |
| ..... | .................. | .................. | ...... | ............ | SQRST..YGG.. | 0.01 | 1 |
| NA... | .................. | .........NF...... | R...D. | .D.......... | A..A........ | 0.01 | 1 |
| AA... | F......G..SE.T...R | .........NF...... | R...D. | E.GT.ND.A.DG | A..A........ | 0.01 | 1 |
| ..... | .................. | .................. | S..TDR | ............ | A..A........ | 0.01 | 1 |
| AA..T | .................. | .................. | ...... | ..TG.N.IAF.D | A..A........ | 0.01 | 1 |
| ..... | ..........L..L.Q.G | .QPSQ....NF...... | E..NGR | ............ | A..A........ | 0.01 | 1 |
| ..... | F................. | .V........F...... | ...... | ............ | NPRAD..VHM.A | 0.01 | 1 |
| ..... | .................. | .................. | ...DDR | .NASG..A.VGQ | A..A........ | 0.01 | 1 |
| E.... | F.....ASA.S..T.T.G | .QPG......F...... | ...DDR | ............ | ............ | 0.01 | 1 |
| EA... | F.....S...H......L | .................. | ...... | ES.DRN.....Q | A..A........ | 0.01 | 1 |
| AA... | F.....SGA..K.N.S.S | .V........F...... | ...... | ............ | A..A........ | 0.01 | 1 |
| ..... | ................L | TKDDR....DF...... | ...D.R | ............ | A..A........ | 0.01 | 1 |
| GT... | .................. | .QANH.....F......T | R..D.. | .SAKAA.AA.DE | A..A........ | 0.01 | 1 |
| ..... | .................. | .V........F...... | ..D... | ............ | A..A.E...... | 0.01 | 1 |
| ..... | .................. | .........DF......T | ...DDR | .SATTGD..VDR | A..A........ | 0.01 | 1 |
| ..... | .................. | .................. | ...ND. | ..ATT..T.F.Q | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| EA..T | F.....NGG.HV.....L | ................. | ...... | ............ | A..A........ | 0.01 | 1 |
| ..... | ................. | ................. | ...... | ............ | ............ | 0.01 | 1 |
| GA... | ................. | ................. | E..AD. | .SAKAA.AA.DE | A..A........ | 0.01 | 1 |
| T.... | ................. | ................. | E..N.. | ............ | ............ | 0.01 | 1 |
| E.... | ................. | ................T | E..DD. | ............ | ............ | 0.01 | 1 |
| ..... | F................. | .V........F....... | ...... | ............ | DKRG...VGV.T | 0.01 | 1 |
| TT..T | ................. | ................. | R...GR | E.AG...IAVDR | A..A........ | 0.01 | 1 |
| GA... | F.....G.G.HA.T.G.R | TKDT.....NF....... | ...DDR | .DTGASD.A.GN | A..A........ | 0.01 | 1 |
| ..... | ................. | ........NF....... | ...D.. | EDAG...I..GQ | A..A........ | 0.01 | 1 |
| G.... | F.....STG.LQ.L.D.R | .QP.G.....F....... | G..D.. | ............ | A..A........ | 0.01 | 1 |
| AA... | ................. | ........DF....... | G..KD. | ENASG.....GN | A..A........ | 0.01 | 1 |
| SA... | ................. | TQ.TG....DF....... | ...DDR | ..GTAGDI..GG | A..A........ | 0.01 | 1 |
| TT..T | ................. | ..........F......T | ...DGR | ............ | A..A........ | 0.01 | 1 |
| ST... | F......KT.NV.K.T.H | T..NE....DF......T | R..DD. | ............ | A..A........ | 0.01 | 1 |
| D...T | F.....DA..IA.L.K.R | .QPN......F......T | ...N.. | ............ | A..A........ | 0.01 | 1 |
| R.... | F.....GGG.PL.M.A.R | ................. | ....G. | ENAG.A...AVGG | A..A........ | 0.01 | 1 |
| .A... | F.....DNT.SK.L...K | ..PN.....NF......T | R..ND. | .DADGD...VDQ | A..A........ | 0.01 | 1 |
| GT... | ................. | ..HG............. | E..ND. | ............ | ............ | 0.01 | 1 |
| ..... | F................. | .V........F....... | ...... | ............ | TRRDG..FGE.H | 0.01 | 1 |
| ..... | F................. | .V........F....... | ...... | ............ | GDRGN..IS... | 0.01 | 1 |
| R.... | F.....NKT.I..K.... | ..DGE....DF....... | ...... | E.AGAADA.VDH | A..A........ | 0.01 | 1 |
| D...T | F................. | ...V.....NF....... | ....D. | ............ | ............ | 0.01 | 1 |
| DA... | ................. | .Q.DR.....F....... | ....D. | EDTAT..AE..D | A..A........ | 0.01 | 1 |
| G...T | F.....AN..RH...E.K | ..DGE....DF....... | ...... | ............ | A..A........ | 0.01 | 1 |
| TA..T | F.....NA..RM.M.K.. | ...T.....DF......T | R..DG. | ............ | A..A........ | 0.01 | 1 |
| ..... | F................. | .V........F....... | ...... | ............ | GQQA...V.K.H | 0.01 | 1 |
| ..... | F................. | .KDSR....DF....... | E..ND. | ............ | A..A........ | 0.01 | 1 |
| TA... | F.....NNG..V.K.P.R | Q.......DF....... | R...D. | .DTG.N..A..R | A..A........ | 0.01 | 1 |
| TA... | ................. | .QAS......F....... | ...... | .DATA..A.Y.H | A..A........ | 0.01 | 1 |
| T...T | ................. | .Q.DR....DF......T | ...DD. | .SGS.N..AV.D | A..A........ | 0.01 | 1 |
| ..... | F................. | .V........F....... | ...... | ............ | AQQAG...NT.E | 0.01 | 1 |
| ..... | .........IA.....K | ................. | R..D.. | ..AATADIE.D. | A..A........ | 0.01 | 1 |
| ..... | F.....SG..IK.K.D.R | T.P......DF....... | ....D. | .DAG.A.I..DG | A..A........ | 0.01 | 1 |
| GA..T | ......NN..SA.N...R | ................. | E..AD. | ............ | A..A........ | 0.01 | 1 |
| E.... | F.....G.G.HA.T.G.R | TKPS......F....... | ...... | .NTGRSDA...S | A..A........ | 0.01 | 1 |
| RA... | F.....SHG.II.K.H.R | ..DGE....DF....... | ...... | ESATGD..E.GQ | A..A........ | 0.01 | 1 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ...V.....NF....... | ...DDR | EDAG...I..GQ | A..A........ | 0.01 | 1 |
| ..... | ................. | .........NF....... | ...DDR | E..G.A..E.GR | A..A........ | 0.01 | 1 |
| SA... | ................. | .........F......T | R..AD. | EDGKGN..AFDE | A..A........ | 0.01 | 1 |
| ..... | F................ | .........NF....... | R..D.. | ............ | A..A........ | 0.01 | 1 |
| ..... | ................. | ................. | E..T.. | ............ | ............ | 0.01 | 1 |
| GT... | F................ | .V........F...... | ...... | ............ | NTRAG..IG..K | 0.01 | 1 |
| ..... | ................. | ................. | E...ND | E.AGAND.AV.H | A..A........ | 0.01 | 1 |
| RA... | ................. | ................. | E..T.. | ............ | A..A........ | 0.01 | 1 |
| ..... | ................. | ................. | ...D.. | ED..A..IAF.D | A..A........ | 0.01 | 1 |
| D.... | F.....AEG.LK.M.H.L | ..DGE....DF....... | ...... | ............ | A..A........ | 0.01 | 1 |
| .A... | ................. | .QAS......F....... | ...... | EDAAG..A.VGS | A..A........ | 0.01 | 1 |
| ..... | F.....DAT..L.I.N.R | .KPDQ....DF....... | R...G. | E.GDGS...F.R | A..A........ | 0.01 | 1 |
| .A... | F.....GNG.HV.H.G.R | ..YN......F......T | ...D.R | E.AG...IAVDR | A..A........ | 0.01 | 1 |
| R.... | .........NP.M.E.R | TQYT.....NF......T | R..DD. | ............ | A..A........ | 0.01 | 1 |
| T.... | F.....SA..RA.....R | T.P......DF....... | ....D. | ............ | A..A........ | 0.01 | 1 |
| NA.GT | ................. | TQASG....NF....... | ....D. | E.AS...IEYGQ | A..A........ | 0.01 | 1 |
| ..... | F.....AT..NN.T.S.H | .QPG.....NF....... | ...DDR | ............ | A..A........ | 0.01 | 1 |
| A...T | ................. | ................. | E..NGR | .NAGA.D.AFDE | A..A........ | 0.01 | 1 |
| GT... | F.....ASG.SV.I.S.R | ................. | ...... | ..AG.DD...GG | A..A........ | 0.01 | 1 |
| TA... | F................ | .KDDR....DF....... | ...DDR | ESAKTADAAVDD | A..A........ | 0.01 | 1 |
| ..... | ................. | ................. | ...DD. | .D.GGGDAEV.Q | A..A........ | 0.01 | 1 |
| .A... | F.....DGT..V.H.H.V | ..V.......F....... | ...... | ............ | ............ | 0.01 | 1 |
| NA... | ................. | ................T | ...ADR | ............ | A..A........ | 0.01 | 1 |
| R.... | ................. | ..DGE....DF....... | ...... | EDGS...AE.DR | A..A........ | 0.01 | 1 |
| ..... | ................. | TQPGG....NF....... | R...D. | ..ATED..A.D. | A..A........ | 0.01 | 1 |
| ..... | ................. | ................. | ...... | .D.......... | A..A........ | 0.01 | 1 |
| TA... | F.....NDG.IV.M.... | ..DGE....DF....... | ...... | ............ | ............ | 0.01 | 1 |
| ..... | F................ | .V.......F....... | ...... | ............ | GKSSN..ANG.. | 0.01 | 1 |
| PT... | ................. | T..SG....DF....... | ...DD. | ..AKGD.A.V.S | A..A........ | 0.01 | 1 |
| G.... | F.....DKG.HM.L.G.R | ................. | ...NGR | ............ | A..A........ | 0.01 | 1 |
| ..... | ................. | ................. | ...DDR | .SAG.D..AFDG | A..A........ | 0.01 | 1 |
| D...T | F.....STA.HV.K.Q.M | ..DGE....DF....... | ...... | ..ARGADAE..S | A..A........ | 0.01 | 1 |
| ..... | ................. | ................. | R..DD. | E..KAS..AVDH | A..A........ | 0.01 | 1 |
| D.... | F......GA.HK.T.D.R | ................F. | R..AD. | ESG..N.I..DG | A..A........ | 0.01 | 1 |
| E.... | F.....NTG.LH.T...R | .Q.D.....DF..P.... | ...ND. | ............ | A..A........ | 0.01 | 1 |
| GA... | ................. | ................. | ...N.. | ...G.N.A.... | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| DT... | F.....NR..N..I.T.G | ..ADH....DF....... | R...D. | KNTTEN....DG | A..A........ | 0.01 | 1 |
| ..... | F.....GRG.H..P.E.R | .Q.DR.....F....... | ....D. | ............ | A..A........ | 0.01 | 1 |
| .A... | F.....STA..Q.H.Q.L | T.P......DF....... | R...D. | ............ | ............ | 0.01 | 1 |
| ..... | F....A...ND.T...K | ..P.E....NF......T | ...A.. | ............ | A..A........ | 0.01 | 1 |
| ..... | ................. | ..........NF....... | G..NDR | ............ | A..A........ | 0.01 | 1 |
| A.... | F.....AQ...A.L.... | .V........F....... | ...... | ............ | A..A........ | 0.01 | 1 |
| ..... | F.....AGA.HK.N.G.G | .........NF....... | R...D. | ............ | ............ | 0.01 | 1 |
| E.... | ................. | ................. | ...AG. | E.AAAN..E.DG | A..A........ | 0.01 | 1 |
| ..... | ................. | ......D.......... | E..KD. | ............ | ............ | 0.01 | 1 |
| RA..T | F......GA.HP.K...V | ..DGE....DF....... | ...... | ............ | A..A........ | 0.01 | 1 |
| ..... | ................. | ................. | ...... | E.AG.DDA...R | A..A........ | 0.01 | 1 |
| ..... | F......A..NL...A.N | ................. | G..ND. | .NGGGN...VDQ | A..A........ | 0.01 | 1 |
| EA... | F.....AST.HD.T.E.R | ................. | ...... | ............ | A..A........ | 0.01 | 1 |
| ..... | F......R..PN.T.A.M | ................. | ...... | ............ | AAQTS..AQI.T | 0.01 | 1 |
| GT..T | ................. | ................. | ...N.. | E..G.SDAA.GD | A..A........ | 0.01 | 1 |
| .A... | F.........HK.P.N.G | T.P......DF....... | ...D.. | ............ | A..A........ | 0.01 | 1 |
| ..... | ................. | ................. | G..ND. | E.ADRN....GS | A..A........ | 0.01 | 1 |
| AA..T | F.....GN..NK.H.A.L | T.P......DF....... | ...D.. | .N.AGA.AEYDD | A..A........ | 0.01 | 1 |
| ..... | ................. | ................. | ...... | E.ANGA.IE.GD | A..A........ | 0.01 | 1 |
| GA... | F.....ASG.SV.I.S.R | .........NF....... | R...D. | E.T..S..A..R | A..A........ | 0.01 | 1 |
| .A... | F.....NGG.NV.N.K.G | TQASH.....F....... | ...DDR | ............ | A..A........ | 0.01 | 1 |
| ..... | F................. | .V........F....... | ...... | ............ | .PRTA..SEG.. | 0.01 | 1 |
| ..... | F.....AAG.SE.I.G.. | .........DF....... | ...D.. | ............ | ............ | 0.01 | 1 |
| ..... | ................. | TKAG....NF....... | ....GR | ............ | A..A........ | 0.01 | 1 |
| ..... | ................. | TKAT....NF.......T | ...D.. | .DAGAN.AEVDH | A..A.......K | 0.01 | 1 |
| D...T | ................. | ................. | ...... | ............ | ............ | 0.01 | 1 |
| ..... | F................. | .V........F....... | ...D.. | ............ | A..A........ | 0.01 | 1 |
| ..... | ................. | ................. | ...... | .NTSGSDI..DE | A..A........ | 0.01 | 1 |
| G.... | ................. | .KDSR....DF....... | ...D.. | EDGGRG...V.D | ............ | 0.01 | 1 |
| E.... | F.....R..HE...N.N | .V........F....... | ...... | E.GSGS..AVD. | A..A........ | 0.01 | 1 |
| RA... | F.....GGT.PM.K.D.R | .........F......T | R..N.. | ............ | A..A........ | 0.01 | 1 |
| ..... | ................. | .QPSQ....NF....... | E..TGR | ............ | A..A........ | 0.01 | 1 |
| ..... | F................. | .V........F....... | ...... | ............ | ARRDP..F.N.E | 0.01 | 1 |
| ..... | F................. | .V........F....... | ...... | ............ | N.QDT..ARS.A | 0.01 | 1 |
| A.... | F.....AEG.LK.M.H.L | ..DGE....DF....... | ...... | ............ | ............ | 0.01 | 1 |
| .T... | ................. | ..DGE....DF....... | ...... | ENGKTND.A..G | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| KA... | F.....GRA.SV.M.K.G | ..DGE....DF....... | ...... | .DGGGS.....G | A..A........ | 0.01 | 1 |
| ..... | F................. | .V........F....... | ...... | ............ | SRSNT..YHV.. | 0.01 | 1 |
| AA... | .................. | T.P......DF....... | ...DD. | .NTRRGDIE..D | A..A........ | 0.01 | 1 |
| ..... | .................. | .................. | ...... | ESGAAA..EV.Q | A..A........ | 0.01 | 1 |
| ..... | .................. | .................. | ....D. | E.AGTNDI...R | A..A........ | 0.01 | 1 |
| .A... | F.....AKG.P..H.P.R | .KDDG....NF......T | R...DR | E..GANDI..GS | A..A........ | 0.01 | 1 |
| EA... | .................. | .KYT.....NF....... | ...NDR | ED.R.S.A...G | A..A........ | 0.01 | 1 |
| ..... | .................. | .QHNQ.....F......T | R..TG. | ............ | A..A........ | 0.01 | 1 |
| ..... | F.....DGA.R..P.A.K | .........NF....... | R...D. | ............ | A..A........ | 0.01 | 1 |
| ..... | F.....SGG.RV.P...G | .................. | ...DDR | ..AST..AA..D | A..A........ | 0.01 | 1 |
| ..... | .................. | .................. | ...N.R | E.AAAA..AF.S | A..A........ | 0.01 | 1 |
| ..... | .................. | .V........F....... | ...... | ............ | GRKDR..DKI.D | 0.01 | 1 |
| G.... | .................. | .................. | E..ND. | ............ | ............ | 0.01 | 1 |
| ..... | F.....DGT.SM.N.G.R | ..DGE....DF....... | ...... | ............ | A..A........ | 0.01 | 1 |
| ..... | .................. | .................. | R..DDR | EDTSA..A.YDG | A..A........ | 0.01 | 1 |
| A.... | .................. | .................. | G..ND. | ............ | A..A........ | 0.01 | 1 |
| A.... | F.....NA..RL.T.P.G | T.P.......F....... | R..DD. | ............ | A..A........ | 0.01 | 1 |
| .A... | F.....ASA.S..T.T.G | .QPG.....DF....... | ...DDR | ............ | ............ | 0.01 | 1 |
| ..... | .................. | .................. | R..DG. | ES.TTG..A..G | A..A........ | 0.01 | 1 |
| ..... | .................. | .................. | ....D. | .DANTN.A.VDS | A..A........ | 0.01 | 1 |
| ..... | .................. | .........DF....... | ...... | ED.GAG..AV.G | A..A........ | 0.01 | 1 |
| ..... | .................. | .................. | ....GR | EDAG.SD.E..H | A..A........ | 0.01 | 1 |
| G.... | F.....ASG.SI.T...R | ..YN......F......T | ...... | ED.G.N....GG | A..A........ | 0.01 | 1 |
| .A... | F.....ATA..V.H...R | .QAS......F....... | ...... | .SGDE.D.E.DR | A..A........ | 0.01 | 1 |
| E.... | F................. | .................. | ...... | ............ | ............ | 0.01 | 1 |
| E.... | .................. | ..DGE....DF....... | ...... | E.TGRA..A..G | A..A........ | 0.01 | 1 |
| D.... | .................. | ..DGE....DF....... | R...D. | .DGDTN.I.V.R | A..A........ | 0.01 | 1 |
| D...T | F.....SAG..L.H...K | .V........F....... | ...... | ES.G.AD.EFGE | A..A........ | 0.01 | 1 |
| TA... | F.....AEG.LK.M.H.L | ..DGE....DF....... | ...... | ............ | ............ | 0.01 | 1 |
| ..... | F.....SGA..N...G.R | .Q.DH....NF....... | ...DD. | .NAA.A....GD | A..A........ | 0.01 | 1 |
| R.... | F.....SA..RA.....R | ..DGE....DF....... | ...... | ..TKRDD.A.DE | A..A........ | 0.01 | 1 |
| ..... | .................. | .................. | ....GG | ..AG.N.AA.GQ | A..A........ | 0.01 | 1 |
| ..... | .................. | .................. | ...D.R | ............ | A..A........ | 0.01 | 1 |
| ..... | .................. | .................. | R..D.R | ..ATESD..FDQ | A..A........ | 0.01 | 1 |
| TA... | .................. | ..HG.....NF......T | ...... | ............ | A..A........ | 0.01 | 1 |
| TT... | F.....GHA.SK.T.E.K | .KYT.....NF......T | ...... | ..AGAN...FGE | A..A........ | 0.01 | 1 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| GA... | F................. | .QDGH....DF......T | E..AGR | ..AG.DDIA.DN | A..A........ | 0.01 | 1 |
| TA..T | ................. | ..DGE....DF....... | R...D. | ........... | ............ | 0.01 | 1 |
| AA... | F.....GRG.H..P.E.R | ..DD.....DF....... | R...D. | .NGRG.D.E.DG | A..A........ | 0.01 | 1 |
| EA... | ................. | ................. | ...... | E.TGT...EVGQ | A..A........ | 0.01 | 1 |
| T.... | F.....GKG.SM.P.G.V | T.P......DF....... | ...D.. | EDAGT...AFD. | A..A........ | 0.01 | 1 |
| ..... | F.....GGG....K.G.R | TQPTE....DF....... | ...... | ..ATRSD..YGH | A..A........ | 0.01 | 1 |
| .A... | F................. | TQP.R....NF......T | G..DD. | ........... | A..A........ | 0.01 | 1 |
| R.... | F.....SGG.SH...A.R | TQASG.....F....... | ...D.. | ........... | A..A........ | 0.01 | 1 |
| G...T | ................. | .Q.GQ....DF....... | ....G. | EDAGRN...V.N | A..A........ | 0.01 | 1 |
| ..... | ................. | T.P......DF....... | ...DDR | E.AGRDD..V.E | A..A........ | 0.01 | 1 |
| G.... | ................. | ................. | ...DDR | .NATG....VGS | A..A........ | 0.01 | 1 |
| E.... | F.....DAA.IK.T.Q.N | ..DGE....DF....... | ...... | E.......... | ............ | 0.01 | 1 |
| KA... | F.....NGT.IL.T.A.K | .QAS.....NF......T | ....GR | ........... | ............ | 0.01 | 1 |
| ..... | ................. | ................. | R..DG. | EDASG....FDR | A..A........ | 0.01 | 1 |
| GT... | ................. | ..A.............. | E..ND. | ........... | ............ | 0.01 | 1 |
| ..... | ................. | TQ.GR....NF....... | ...... | ........... | A..A........ | 0.01 | 1 |
| ..... | ................. | ................. | E..AD. | .DASGS....GR | A..A........ | 0.01 | 1 |
| ..... | F................. | .V.......F....... | ...... | ........... | DRQAG..IQE.. | 0.01 | 1 |
| AT... | F.....GKA.SE.N...L | .QPG.....NF....... | ...DDR | ........... | A..A........ | 0.01 | 1 |
| H.... | ......S..NP.N.Q.K | .QPN......F......T | ...N.. | ..AGGADIEFDQ | A..A........ | 0.01 | 1 |
| .T... | F.....DAG.LK.L...G | T.P......DF....... | ...D.. | ........... | A..A........ | 0.01 | 1 |
| ....T | ................. | .KYT.....NF......T | ...D.. | ..A.A.D.AFDS | A..A........ | 0.01 | 1 |
| N.... | F......GT.NM.L.Q.G | .QDT.....DF....... | G..T.. | E.AGAND.AY.N | A..A........ | 0.01 | 1 |
| N.... | ................. | TQ.TH....DF....... | ....D. | EN.GTN.AE.DN | A..A........ | 0.01 | 1 |
| ..... | ................. | ..AGR....DF......T | ....D. | ........... | A..A........ | 0.01 | 1 |
| R.... | ................. | ..HG.....NF......T | ...A.. | ........... | A..A........ | 0.01 | 1 |
| NA... | F.....GKG.NQ...P.K | TK.NE....NF....... | ..GR | EDGG.S..E.DR | A..A........ | 0.01 | 1 |
| ..... | F................. | .V........F....... | ...... | ........... | DPRTT...NA.T | 0.01 | 1 |
| G.... | F.....SA..RA.....R | .QPN......F......T | ...N.. | .D.TAG..E..E | A..A........ | 0.01 | 1 |
| ET..T | F.....GDT..L...K.K | TQASG.....F....... | ...... | .SARG..A..DE | A..A........ | 0.01 | 1 |
| A.... | ................. | .K.TG....DF....... | R...DR | EN.GGS.IEVGG | A..A........ | 0.01 | 1 |
| ..... | ................. | ................. | G..N.. | E.......... | A..A........ | 0.01 | 1 |
| ..... | F.....SAA.NK.L.G.L | TK.NE....NF....... | ....GR | ........... | A..A........ | 0.01 | 1 |
| ..... | F.....DRG.PI.L.A.R | TQPT......F......T | ...DG. | ........... | A..A........ | 0.01 | 1 |
| ..... | ................. | ................T | G..TG. | ........... | ............ | 0.01 | 1 |
| E.... | ................. | ................. | E..AG. | ........... | ............ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F.......T.SV...H.R | .Q.S......F....... | ...A.. | ENAG.SD.E..H | A..A........ | 0.01 | 1 |
| ..... | F................. | .V........F....... | ...... | ............ | NSRT...FQS.Q | 0.01 | 1 |
| ..... | ................. | ................. | ...D.. | EN.G.A.....Q | A..A........ | 0.01 | 1 |
| ..... | ................. | .........DF..P.... | R..DD. | .DGTTA.A.VDQ | A..A........ | 0.01 | 1 |
| A.... | ................. | .K.TG....DF...... | R...DR | ..ATRS.I..GN | A..A........ | 0.01 | 1 |
| ..... | ................. | ................. | ...DDR | ..AG..D..YGE | ............ | 0.01 | 1 |
| ..... | ................. | ................. | ...D.. | E.AGGN...FGE | A..A........ | 0.01 | 1 |
| AA... | F.....SK..PA.K.A.G | ................. | ...... | E.AGG.DI..GH | A..A........ | 0.01 | 1 |
| ..... | ................. | ................. | E..KD. | ...RRND...DR | A..A........ | 0.01 | 1 |
| .A... | F................. | .V........F....... | ...... | ............ | SSRGP..FTG.D | 0.01 | 1 |
| G.... | F.....SRG.PV.P.N.R | .Q.DR.....F....... | ...D.. | E.TGRND.A..E | A..A........ | 0.01 | 1 |
| EA. | ................. | ................. | ...N.. | ES.TTG.IE.DR | A..A........ | 0.01 | 1 |
| ..... | ................. | ................. | ...DDR | .STAES.I..DG | A..A........ | 0.01 | 1 |
| ..... | F................. | .V........F....... | ...... | ............ | SARTG..SNT.D | 0.01 | 1 |
| H.... | F.....GNG.HV.H.G.R | ..........DF...... | ...DDR | ............ | ............ | 0.01 | 1 |
| ..... | ................. | .KDSR....DF....... | P,.NDR | ............ | A..A........ | 0.01 | 1 |
| ..... | ................. | .QPN......F......T | ....D. | ES.NRD....GQ | A..A........ | 0.01 | 1 |
| ..... | F................. | .V........F....... | ...... | ............ | DSKAG...RG.. | 0.01 | 1 |
| ..... | ................. | T.HTR....DF......T | ...... | ............ | ............ | 0.01 | 1 |
| AA... | ................. | T..NE....DF......T | R..DD. | ............ | ............ | 0.01 | 1 |
| NT..T | F.....GKT.I..N...S | ..DGE....DF....... | ...DDR | ............ | A..A........ | 0.01 | 1 |
| ..... | ................. | ................. | ...... | ............ | GQRSH..DRN.E | 0.01 | 1 |
| ..... | ................. | ................. | ...DDR | EDGKGA....GE | A..A........ | 0.01 | 1 |
| H.... | ................. | .V........F....... | ...... | .DAAGA.IE.GN | A..A........ | 0.01 | 1 |
| TA... | F.....DTG.SK.T.T.R | .V........F....... | ...... | .NATEGDI..GG | A..A........ | 0.01 | 1 |
| ..... | ................. | .V........F....... | ...DDR | ............ | ............ | 0.01 | 1 |
| ..... | ................. | ...TG....NF......T | ...... | .DTAAA...VGE | A..A........ | 0.01 | 1 |
| A.... | ................. | TQASG.....F....... | R..DDR | E..K.GDA...S | A..A........ | 0.01 | 1 |
| ..... | F.....SKA.S..L.E.R | .QPTG....DF....... | R..... | E.T..S.....R | A..A........ | 0.01 | 1 |
| TA... | ................. | .Q.DR....F........ | ....GR | ESAGAD..AY.. | A..A........ | 0.01 | 1 |
| ..... | ................. | ................. | R..DD. | ............ | TQRSP..S...T | 0.01 | 1 |
| ..... | F.....NGG.NN.K.T.R | TQ.TG....NF....... | ...... | E.AAESD.A..Q | A..A........ | 0.01 | 1 |
| ..... | F................. | .V........F....... | ...... | ............ | TSKDA..I.T.A | 0.01 | 1 |
| ..... | F................. | .V........DF...... | R...D. | ............ | ............ | 0.01 | 1 |
| T...T | F.....NS..LV.I.S.R | ..DGE....DF....... | ...... | ............ | ............ | 0.01 | 1 |
| .A... | F.....GS..NM.N.T.R | ................. | ...... | ............ | A..A........ | 0.01 | 1 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| G.... | F................. | .V........F....... | ...... | ............ | TTKAA..SQ..P | 0.01 | 1 |
| ..... | F................. | .V........F....... | ...... | ............ | ARSDG..AGA.. | 0.01 | 1 |
| G.... | F.....AEG.LK.M.H.L | ..DGE....DF....... | ...... | ............ | ............ | 0.01 | 1 |
| H.... | F.....DNT.SK.L...K | ..DGE....DF....... | ...... | E.AAGD.I.V.R | A..A........ | 0.01 | 1 |
| ..... | ................. | .........F......T | R..TGR | .SAS.ADAE.GS | A..A........ | 0.01 | 1 |
| ..... | ................. | .KDDR....DF....... | ...DDR | ESAKTADAAVDD | A..A........ | 0.01 | 1 |
| DA... | F.....STG.NP.M.E.R | TQYDR....NF....... | R...D. | ............ | A..A........ | 0.01 | 1 |
| G.... | F.....NQT.RN.T.D.R | .........NF....... | R...D. | ............ | A..A........ | 0.01 | 1 |
| GA... | ................. | ................. | R..N.. | ES.GAA..AVDG | A..A........ | 0.01 | 1 |
| R...T | ...........H.S.V | TQ.TG....DF....... | ...DDR | ............ | A..A........ | 0.01 | 1 |
| ..... | F.....SRT..A...T.N | ..DGE....DF....... | ...... | ............ | A..A........ | 0.01 | 1 |
| ..... | F................. | .V........F....... | ...... | ............ | .DHSP..FHE.A | 0.01 | 1 |
| ..... | F......AG..L.T.N.R | .KAS.....DF....... | E..ND. | E.TGRA..A..G | A..A........ | 0.01 | 1 |
| ..... | F................. | .V........F....... | ...... | ............ | GARNP...GN.A | 0.01 | 1 |
| A.... | ................. | ................. | ...DD. | ............ | ............ | 0.01 | 1 |
| NT... | F.....NAT.LV.T.H.R | ................. | ...... | ............ | ............ | 0.01 | 1 |
| G.... | ................. | .V........F....... | ...... | E.AA.SD.AVGG | A..A........ | 0.01 | 1 |
| E.... | ................. | ..DGE....DF....... | R...D. | ............ | ............ | 0.01 | 1 |
| ..... | ................. | .Q.......DF....... | R..A.. | .DAGGN.IAY.S | A..A........ | 0.01 | 1 |
| ..... | ......GHA.SK.T.E.K | T.PTG....DF....... | ...... | ............ | A..A........ | 0.01 | 1 |
| ..... | F................. | .V........F....... | ...... | ............ | GQRGE..ATA.H | 0.01 | 1 |
| EA... | F.....ANG.HL.K.K.S | .QAS......F....... | R,.N.. | ............ | A..A........ | 0.01 | 1 |
| ..... | ................. | ................. | ....GR | .DARGN..E.DQ | A..A........ | 0.01 | 1 |
| ..... | ................. | ................. | ...... | EDANG...EV.N | A..A........ | 0.01 | 1 |
| GT... | ................. | ..HG.....NF......T | ...DD. | ............ | ............ | 0.01 | 1 |
| R.... | ................. | .PPNG.....F......T | ...DDR | E..NA....YDR | A..A........ | 0.01 | 1 |
| ..... | F.....NR..N..I.T.G | ..ADH....DF....... | R...D. | KNTTEN....DG | A..A........ | 0.01 | 1 |
| RA... | F.....GRG.NN.T.G.. | ...DG...DF....... | ...D.. | ............ | A..A........ | 0.01 | 1 |
| ..... | ................. | ................. | E..TD. | ............ | A..A........ | 0.01 | 1 |
| RA... | F.....DTA.N....E.R | T.P......DF....... | ...DDR | ..GGGS..A.DG | ............ | 0.01 | 1 |
| GT... | F.....ASA.S..T.T.G | ..HG.....NF......T | E..DD. | ............ | ........R..H | 0.01 | 1 |
| RA..T | F.....GS..NM.N.T.R | .QP.G....DF....... | ...... | ..A.A.D.AFDS | A..A........ | 0.01 | 1 |
| ..... | F................. | .V........F....... | ...... | ............ | GRQST..SDE.A | 0.01 | 1 |
| GA... | F.....DRA.IN.M.K.L | .Q.S......F....... | ...DDR | ............ | A..A........ | 0.01 | 1 |
| ..... | F................. | .V........F....... | ...... | ............ | TTRGP..SKA.E | 0.01 | 1 |
| ..... | F................. | .V........F....... | ...... | ............ | GNRNN..I.V.T | 0.01 | 1 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F.....NKT.HL.T.A.R | .QANH.....F......T | ...DDR | .SGKTADAEVGD | A..A........ | 0.01 | 1 |
| ..... | F.....NQA.RK.P.P.L | .V........F....... | ...... | ............ | A..A........ | 0.01 | 1 |
| ..... | F................. | .V........F....... | ...... | ............ | NPHTH..NT..P | 0.01 | 1 |
| ..... | .................. | .................. | R...D. | EDADGS..AF.Q | A..A........ | 0.01 | 1 |
| TA... | .................. | .Q.DH....NF....... | ...DD. | .NAG.NDT..DG | A..A........ | 0.01 | 1 |
| ..... | .................. | .................. | R..AD. | ESAGRNDIA.DQ | A..A........ | 0.01 | 1 |
| ..... | .................. | .................. | ...... | ............ | TQRSG..IT..E | 0.01 | 1 |
| GT..T | .................. | .................. | E..DDR | ............ | A..A........ | 0.01 | 1 |
| .A... | .................. | T.P......DF....... | ...D.. | .SGT.GD.AVGE | A..A........ | 0.01 | 1 |
| ..... | F................. | .V........F....... | R..G.. | ..GAEN..EF.R | A..A........ | 0.01 | 1 |
| ..... | .................. | .KYT.....NF..P...T | R..D.. | ............ | A..A........ | 0.01 | 1 |
| ..... | .................. | .................. | R..DD. | ..AN.A..AV.G | A..A........ | 0.01 | 1 |
| SA... | F.....GDG.RA.....V | ..DGE....DF......T | G..AD. | ............ | A..A........ | 0.01 | 1 |
| ..... | .................. | .................. | ...TGR | .......A.YDQ | A..A........ | 0.01 | 1 |
| G.... | .................. | .................. | E..ND. | E.TR.N.....Q | A..A........ | 0.01 | 1 |
| ..... | .................. | .................. | R..N.. | ENGAR....... | A..A........ | 0.01 | 1 |
| ..... | .................. | .................. | ...D.R | E.GRGA..AV.E | A..A........ | 0.01 | 1 |
| AA... | F.....SN..PL.K.T.. | .QAS.....NF......T | ...DDR | ............ | A..A........ | 0.01 | 1 |
| D...T | .................. | .................. | ....D. | ............ | ............ | 0.01 | 1 |
| G.... | .................. | .PPNG.....F......T | ...DDR | .SGS.NDIA..D | A..A........ | 0.01 | 1 |
| ..... | .................. | ..HG.....NF....... | ...DDR | ............ | ............ | 0.01 | 1 |
| ..... | .................. | .................. | ...... | E.TGT...EVGQ | A..A........ | 0.01 | 1 |
| DA... | .................. | .................. | ...D.. | EDAGT..AA..H | A..A........ | 0.01 | 1 |
| ..... | F.....GDG....K.Q.R | .QP.G.....F....... | R..NG. | E..G.S.T.FDS | A..A........ | 0.01 | 1 |
| ..... | .................. | ....E....NF......T | G..N.. | E.AAGSD..... | A..A........ | 0.01 | 1 |
| ..... | .................. | ..AGR....DF......T | R..D.. | .D.......... | A..A........ | 0.01 | 1 |
| NA... | .................. | ..........NF...... | ...D.. | .DASGS....GG | A..A........ | 0.01 | 1 |
| NT... | F................. | .V........F....... | ...... | ............ | TPRSP..Y.N.T | 0.01 | 1 |
| ..... | .................. | .................. | R...D. | .DAKGD.A.F.D | A..A........ | 0.01 | 1 |
| ..... | F.....DGA.R..P.A.K | T.P......DF....... | ...D.. | ............ | A..A........ | 0.01 | 1 |
| ..... | F................. | .KYT.....NF......T | R...D. | E.GAGSD.E.D. | A..A........ | 0.01 | 1 |
| ..... | F......KG.SH.H.G.. | ....Q.S...F....... | ...DDR | .NTGGG....DG | A..A........ | 0.01 | 1 |
| ..... | .................. | .................. | ...AGR | .N.NRN.....G | A..A........ | 0.01 | 1 |
| ..... | F................. | .V........F....... | ...... | ............ | GARDG..VRG.E | 0.01 | 1 |
| A.... | ......AEG.LK.M.H.L | ..DGE....DF....... | ...... | ............ | ............ | 0.01 | 1 |
| E.... | .................. | .................. | ....D. | ............ | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| DT... | ................. | ................. | ...DD. | ........... | A..A........ | 0.01 | 1 |
| TT... | ................. | ..HGH....NF......T | ...D.. | ........... | A..A........ | 0.01 | 1 |
| ..... | F................ | .V........F....... | ...... | ........... | SQRST..YGG.. | 0.01 | 1 |
| A.... | ................. | ................. | ...DG. | E.TGRA..A..G | A..A........ | 0.01 | 1 |
| GA... | ................. | ........NF...... | ...... | .DAKG..I.FDG | ............ | 0.01 | 1 |
| ..... | ................. | .QPTG....NF....... | ...... | .SAGRGDAAVDE | A..A........ | 0.01 | 1 |
| AT... | ................. | .PPNG.....F......T | ...DDR | E.ATRA..A.DE | A..A........ | 0.01 | 1 |
| ..... | F......AG.SH.T.A.R | T.P......DF....... | ...DDR | EDGAA.DAA.DE | A..A........ | 0.01 | 1 |
| RT... | F.....DSG.NM.H.A.R | ..HG.....NF.....T | ....G. | ........... | A..A........ | 0.01 | 1 |
| A.... | F.....GQG.IA.....K | .........NF......T | ...... | ........... | A..A........ | 0.01 | 1 |
| ..... | ................. | ................. | ...DD. | E.GNGS....GR | A..A........ | 0.01 | 1 |
| GA... | F................ | .Q.DH....NF....... | ...DD. | ........... | A..A........ | 0.01 | 1 |
| NA..T | ................. | ..AGR.....F.....T | R..D.. | .N.TA.DI.VDG | A..A........ | 0.01 | 1 |
| E.... | ................. | .Q.DR....DF....... | ...NGR | .SAKAA.AA.DE | A..A........ | 0.01 | 1 |
| NA... | ................. | ................. | ...... | ........... | ............ | 0.01 | 1 |
| NT... | F.....NQG.RV.T...L | .V........F.... | ...... | ESAGAA....GE | A..A........ | 0.01 | 1 |
| ..... | ................. | ................. | ...A.. | E..RRA..AV.D | A..A........ | 0.01 | 1 |
| ..... | ................. | ................. | ...... | EDAS....A.GQ | A..A........ | 0.01 | 1 |
| ..... | ................. | ................. | ...... | E.AKTD....GR | A..A........ | 0.01 | 1 |
| ..... | ................. | .Q.S......F....... | R..DD. | E.AGTDD.EVDE | A..A........ | 0.01 | 1 |
| DA... | F.....NR..LD.T...R | ................. | ...... | ........... | A..A........ | 0.01 | 1 |
| A.... | F.....NAG.LL.T.H.M | ................. | ...... | E.AG.S..E.DN | A..A.....Y.. | 0.01 | 1 |
| DT... | F................ | ..DGE....DF....... | R...D. | ........... | ............ | 0.01 | 1 |
| ..... | ................. | .QPN......F......T | ...N.. | E.AGAND.AV.H | A..A........ | 0.01 | 1 |
| TT..T | ................. | .V............... | ...DDR | ........... | ............ | 0.01 | 1 |
| ..... | F................ | .V........F....... | ...... | ........... | TQRAG..FNS.E | 0.01 | 1 |
| ..... | ......NAT.IM.T.H.R | T.P......DF....... | ...D.R | ........... | ............ | 0.01 | 1 |
| NT..T | ................. | ................. | E..ND. | ........... | ............ | 0.01 | 1 |
| ..... | ................. | ................. | ...N.R | ..AG.N.AA.GQ | A..A........ | 0.01 | 1 |
| DA... | F......NG.LQ.H...N | T.P......DF....... | ...D.. | ........... | ............ | 0.01 | 1 |
| HA... | F.....NGG.HN.H...G | TQASG.....F....... | ...... | ........... | A..A........ | 0.01 | 1 |
| ..... | ................. | ................. | ...T.R | ........... | A..A........ | 0.01 | 1 |
| TA... | ................. | ..DNH....NF....... | ...D.. | .NGGTG..A.DR | A..A........ | 0.01 | 1 |
| HT... | ................. | ................. | ...... | ........... | ............ | 0.01 | 1 |
| SA... | F.....NG...A.L.E.K | ..P.G....DF....... | ...D.. | .N.A.SD....G | A..A........ | 0.01 | 1 |
| G.... | ................. | .Q.......DF....... | E..AD. | ........... | A..A........ | 0.01 | 1 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| D...T | F.....AT..ND.K.P.K | .QPN......F.....T | ...N.. | .SAS.N.IA..E | A..A........ | 0.01 | 1 |
| G.... | .................. | ..........F....... | ...... | ............ | DRSST..DTG.D | 0.01 | 1 |
| ..... | .................. | ..PNQ.....F......T | E..NGR | ............ | A..A........ | 0.01 | 1 |
| A.... | .................. | ..DGE....DF....... | R...D. | ............ | GARNA..AEG.E | 0.01 | 1 |
| ..... | F................. | .PHD.....DF......T | R..DG. | ............ | A..A........ | 0.01 | 1 |
| AA... | .......QG.NQ...A.R | ..ADR.....F....... | ....D. | E.GD.A.A...S | A..A........ | 0.01 | 1 |
| .A... | F................. | .................. | ....GR | ..AG.N.AA.GQ | ............ | 0.01 | 1 |
| .A... | F.....NQG..V.L.N.R | .Q.DR.....F....... | ...DDR | ............ | ............ | 0.01 | 1 |
| ..... | .................. | .................. | ...D.R | EDAKGG.....R | A..A........ | 0.01 | 1 |
| ..... | F................. | .V........F....... | ...... | ............ | DPHTR..D.M.. | 0.01 | 1 |
| E.... | F......A..IH.T.T.. | .V........F....... | ...... | E..RG.D..FDG | A..A........ | 0.01 | 1 |
| G.... | F.....SN..PL.K.T.. | .KYT.....NF......T | ...DDR | E.ATA.DAA.DQ | A..A........ | 0.01 | 1 |
| NT..T | P.....SA..RA.....R | .V........F....... | ...... | ESGSGND.E.DR | A..A........ | 0.01 | 1 |
| ..... | .................. | .................. | ...DDR | ENGDTSD.A.DN | A..A........ | 0.01 | 1 |
| ..... | .................. | .................. | ...DG. | .NGGTG..A.DR | A..A........ | 0.01 | 1 |
| TA... | F.....GKG.NQ.K.E.H | .................. | R..ND. | E.AAGN.AAV.E | A..A........ | 0.01 | 1 |
| G.... | F.....DA..IA.L.K.R | TQASG.....F....... | ....D. | .D.D...AEFGD | A..A........ | 0.01 | 1 |
| ..... | F................. | .V........F....... | ...... | ES.SA..I..DR | A..A........ | 0.01 | 1 |
| ..... | .................. | ..YN.............. | ...... | ..AA.N..AV.H | A..A........ | 0.01 | 1 |
| ..... | .................. | ..A......DF....... | ...T.. | ............ | A..A........ | 0.01 | 1 |
| NA... | F................. | .V........F....... | ...... | ............ | GPRTG..VR..Q | 0.01 | 1 |
| ..... | F................. | .V........F....... | ...... | ............ | ..KSG..F.V.E | 0.01 | 1 |
| R.... | .................. | T..NE....DF......T | R..DD. | ............ | ............ | 0.01 | 1 |
| ..... | .................. | .................. | ...DDR | .SAGG..I.YDS | A..A........ | 0.01 | 1 |
| ..... | F................. | .V........F....... | ...... | ............ | GPRA...FTV.H | 0.01 | 1 |
| ..... | F.....SH..LN.N.E.N | ..DGE....DF....... | ...... | ............ | A..A........ | 0.01 | 1 |
| ..... | F.....ST..SV.K.H.M | TQPTH....NF....... | R..DD. | ENGGGGD...DR | A..A........ | 0.01 | 1 |
| G.... | F.....GRT.IN.M.K.L | .........NF....... | ...... | ............ | A..A........ | 0.01 | 1 |
| ..... | .................. | .................. | ...... | E.AG.S...... | A..A........ | 0.01 | 1 |
| EA... | F.....AEG.LK.M.H.L | .KD.E....DF....... | ...... | ............ | ............ | 0.01 | 1 |
| R.... | F.....G.G.RA.N.E.R | T.PTG....DF....... | ...DDR | EDAGT...AFD. | A..A........ | 0.01 | 1 |
| AA... | F.....DTT.LH.K.T.G | .KYT.....NF......T | R...D. | ............ | A..A........ | 0.01 | 1 |
| ..... | F................. | .V........F....... | ...... | ............ | TQRT...DRS.. | 0.01 | 1 |
| ..... | .................. | .QPGQ....NF....... | E..AD. | .SASEN.I..DR | A..A........ | 0.01 | 1 |
| ..... | F.....DRT.PA.....M | .QPN......F.....T | ...N.. | .SAGAN..E..S | A..A........ | 0.01 | 1 |
| E.... | F.....DRG.S..T.A.S | ..DGE....DF....... | ...... | ............ | ............ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F.....SG..IK.K.D.R | .KYT.....NF......T | R..AGR | ............ | ............ | 0.01 | 1 |
| ..... | ................. | ................. | ...DG. | ..AK.ADT..GN | A..A........ | 0.01 | 1 |
| NT... | .......QG.NQ...A.R | ..ADR.....F....... | ....D. | E.GD.A.A...S | A..A........ | 0.01 | 1 |
| G.... | ................. | ................. | ...... | .SGKRA..E.DQ | A..A........ | 0.01 | 1 |
| SA..T | ................. | ..YT.....NF......T | ...DG. | ............ | A..A........ | 0.01 | 1 |
| A.... | F.....SRG.PV.P.N.R | T.P......DF....... | ...D.. | ...KGS.IEYGD | A..A........ | 0.01 | 1 |
| T.... | F.....AST.IN.L.T.. | ................. | ...D.. | ............ | A..A........ | 0.01 | 1 |
| ..... | F................ | .V........F....... | ...... | ............ | GKQS...YST.. | 0.01 | 1 |
| H.... | ................. | ..DGE....DF....... | G..DG. | ............ | ............ | 0.01 | 1 |
| ..... | ................. | ................. | ...... | ..TGAS..EV.N | A..A........ | 0.01 | 1 |
| AT... | ................. | ................. | R..DD. | ............ | ............ | 0.01 | 1 |
| DT... | ................. | ................. | ...... | ENGRGG.AEV.D | A..A........ | 0.01 | 1 |
| RA... | F................ | .V........F....... | ...... | ............ | KDRAA..VHN.H | 0.01 | 1 |
| TT... | F.....DSG.NM.H.A.R | .Q.DH....NF....... | ...... | ............ | A..A........ | 0.01 | 1 |
| AA... | ................. | ................. | ...DDR | E.AG..D.A.GR | A..A........ | 0.01 | 1 |
| RT... | F.....GNG.HV.H.G.R | TKDDR....DF....... | ...D.. | E.AGTNDI...R | A..A........ | 0.01 | 1 |
| ..... | F................ | ..........F....... | ...D.. | ..AG.DDIA.DN | TRQTT...D..P | 0.01 | 1 |
| TA... | F......EG.S..T.K.K | ..A......DF....... | ...DG. | EDGKA.DA..GQ | A..A........ | 0.01 | 1 |
| .A... | F.....GGT.HD.T.S.V | .V........F....... | ...... | .SAKAA.AA.DE | A..A........ | 0.01 | 1 |
| ..... | F................ | .V........F....... | ...... | ............ | ETRDR..STV.D | 0.01 | 1 |
| GT..T | F......GA..K.M...E | ................. | ...... | ..AG.N..AF.R | A..A........ | 0.01 | 1 |
| TT... | ................. | ................. | ....GR | ............ | ............ | 0.01 | 1 |
| TA... | ................. | ................. | ...N.. | ...G.N.A.... | A..A........ | 0.01 | 1 |
| ..... | ................. | ................. | ...D.. | .SAS.N.IA..E | A..A........ | 0.01 | 1 |
| E.... | ................. | .QPG.....NF....... | ...DDR | EDAG.AD.E.G. | A..A........ | 0.01 | 1 |
| DT... | F.....NKT.HL.T.A.R | ..YN......F......T | ...D.R | ............ | A..A........ | 0.01 | 1 |
| ..... | F................ | .V........F....... | ...... | ............ | GPRGG..DEE.. | 0.01 | 1 |
| E...T | F.....DTG.SK.T.T.R | .QPTG.....F....... | ...NGR | ............ | ............ | 0.01 | 1 |
| GT... | ................. | .PANG.....F....... | ...DDR | ...DGSDA..DE | A..A........ | 0.01 | 1 |
| NA... | ................. | ................. | ...DD. | ..GGGS..A.DG | A..A........ | 0.01 | 1 |
| RA... | ................. | ..YN......F......T | ...D.R | ..AGE....VG. | A..A........ | 0.01 | 1 |
| N.... | F.....SG..IK.K.D.R | .........F....... | R..AD. | .NAR.A.I..GE | A..A........ | 0.01 | 1 |
| ..... | ................. | ................. | G..KD. | E..AAS....GG | A..A........ | 0.01 | 1 |
| .A... | F.....GK..LA.K.N.G | .Q.S......F....... | E..N.. | ............ | A..A........ | 0.01 | 1 |
| ..... | ................. | .V........F....... | .....R | ESA.GG..E.GS | A..A........ | 0.01 | 1 |
| ..... | ................. | ................. | ...AD. | ESGSA..I.F.D | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| SA..T | F.....DKG..L.N...R | ..DGE....NF......T | ...D.. | .SANESD...DQ | A..A........ | 0.01 | 1 |
| GT... | F.....GRG.NN.T.G.. | ...DG....DF....... | ...D.. | ............ | A..A........ | 0.01 | 1 |
| G.... | F.....DQ..R..P.S.R | .KD.E.....F..P...T | R...D. | ............ | A..A........ | 0.01 | 1 |
| ET... | F.....NKT.HL.T.T.G | ..DGE....DF....... | ...... | ............ | A..A........ | 0.01 | 1 |
| NA..T | .................. | .........DF....... | ...AD. | ............ | A..A........ | 0.01 | 1 |
| DT... | F.....AGT.PM.K.K.G | .QDGH....DF......T | ...DD. | E.AGRN.T..DD | A..A........ | 0.01 | 1 |
| ..... | .........NM.L...K | .KDT......F......T | ...ND. | ............ | A..A........ | 0.01 | 1 |
| ..... | .................. | .........DF....... | ...D.. | E.TTR.D.E.GS | A..A........ | 0.01 | 1 |
| ..... | .................. | .................. | ...D.. | .DARRN.AE.GS | A..A........ | 0.01 | 1 |
| D.... | F.....ASA.S..T.T.G | .QPG.....DF....... | R...D. | ..ARG.D.AF.H | A..A........ | 0.01 | 1 |
| ..... | F.....SA..RA.....R | TKDDR....DF....... | ...DDR | ............ | A..A........ | 0.01 | 1 |
| ..... | .................. | ..HG.....NF......T | R..AD. | ............ | A..A........ | 0.01 | 1 |
| ..... | .................. | TQP.R....NF......T | R..ND. | ............ | A..A........ | 0.01 | 1 |
| ..... | .................. | TQ.TG....NF....... | ...... | ............ | | 0.01 | 1 |
| G.... | .................. | .QAS......F....... | ...... | .SGNGN...F.H | A..A........ | 0.01 | 1 |
| EA... | F.....GK..SH...E.K | .................. | ...... | E.AT.S.AAF.E | A..A........ | 0.01 | 1 |
| ..... | F.....SGA..N...G.R | .V........F....... | ...... | ..GGESD.E.D. | A..A........ | 0.01 | 1 |
| ..... | F.....GTG.P....K.. | .QPN......F......T | ..D.R | .S.G.S.IA..G | A..A........ | 0.01 | 1 |
| ..... | F................. | .V........F....... | ...... | ............ | GSSSG...TM.Q | 0.01 | 1 |
| SA..T | F.....AEG.NI.L.K.R | ..P.E....NF......T | E..A.. | E.A.A.DIA.D. | A..A........ | 0.01 | 1 |
| H.... | .................. | .QPSQ....NF....... | ...DDR | E.AG...IAVDR | A..A........ | 0.01 | 1 |
| ..... | .................. | .........DF....... | ...DDR | ENASG.....GN | A..A........ | 0.01 | 1 |
| SA... | F......KT.NK...A.G | ...NG....DF....... | G..K.. | ............ | A..A........ | 0.01 | 1 |
| ..... | .................. | .................. | ....GR | ..AG.N.AT.GQ | A..A........ | 0.01 | 1 |
| N.... | .................. | .KYT.....NF......T | ...... | ............ | A..A........ | 0.01 | 1 |
| ..... | .................. | .................. | ...DD. | .SGTG.D...GR | A..A........ | 0.01 | 1 |
| ..... | .................. | .................. | G..K.. | E.TGAA.I..GE | A..A........ | 0.01 | 1 |
| ..... | .................. | .................. | ...NGR | E.AK.N..AFDG | A..A........ | 0.01 | 1 |
| ..... | F......R..PN.T.A.M | .................. | ....D. | ESAG....A.GE | A..A........ | 0.01 | 1 |
| RA... | F.....A.A.NH.T.K.N | TQPTH....DF....... | ...DDR | ............ | A..A........ | 0.01 | 1 |
| ..... | .................. | .........NF....... | ...T.. | ..TGAS.A..DH | A..A........ | 0.01 | 1 |
| ..... | .................. | .................. | ...D.. | ESG..N.I..DG | A..A........ | 0.01 | 1 |
| ..... | .................. | .................. | ...NDR | ..AST..AA..D | A..A........ | 0.01 | 1 |
| G.... | F.....DTG.PA.L.T.K | T.P......DF....... | ...... | ...........K. | ............ | 0.01 | 1 |
| ..... | .................. | .................. | ...DD. | ............ | A..A........ | 0.01 | 1 |
| ..... | F.....AEG.LK.M.H.L | ..DT.....NF......T | ...DD. | ............ | A..A........ | 0.01 | 1 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| NT... | .................. | .Q.......DF....... | ...DDR | .......... | GTKAA..ITS.Q | 0.01 | 1 |
| RA... | F.....G...SP.P.A.R | .V........F....... | ...... | ENGRGS.I..G. | A..A........ | 0.01 | 1 |
| G.... | F.....NN..SA.N...R | T.P......DF....... | ...D.. | EN.G.A.....Q | A..A........ | 0.01 | 1 |
| ..... | .................. | .................. | E..AGR | .......... | A..A........ | 0.01 | 1 |
| ..... | F................. | .V........F....... | ...... | .......... | T.QGR..AH..D | 0.01 | 1 |
| ..... | F................. | .V........F....... | ...... | .......... | N.SAS...SS.K | 0.01 | 1 |
| E.... | F......G..NQ.T.A.G | .V........F....... | ...... | E.AG.ADIE.G. | A..A........ | 0.01 | 1 |
| G.... | F................. | .V........F....... | ...... | .......... | A..A........ | 0.01 | 1 |
| ET..T | F.....AT...N.T...G | .QPNQ....NF...P..T | .....R | .......... | A..A........ | 0.01 | 1 |
| AA... | .................. | TKPSG....NF......T | ...DDR | ..ASAAD.E..D | A..A........ | 0.01 | 1 |
| ..... | .................. | .................. | R..D. | .......... | A..A........ | 0.01 | 1 |
| SA... | .................. | .Q.GQ....DF....... | ....G. | .......... | A..A........ | 0.01 | 1 |
| ..... | .................. | .................. | R..DD. | E.AAAN..E.DG | A..A........ | 0.01 | 1 |
| ..... | F.....ANG.NQ.I.S.G | TQDGQ....NF....... | G..... | .......... | A..A........ | 0.01 | 1 |
| R.... | F.....GS..NK.H...G | T.P......DF......T | ....D. | .......... | A..A........ | 0.01 | 1 |
| AA... | F.....A.G..V.T.H.R | TQASG.....F....... | ...... | .DGG..D.AF.E | A..A........ | 0.01 | 1 |
| SA..T | F......AAG.SE.I.G.. | .........DF....... | ...D. | .......... | ............ | 0.01 | 1 |
| DT... | F................. | .V........F....... | ...... | .......... | DR.AT..FSV.D | 0.01 | 1 |
| ..... | .................. | .................. | E..AD. | .SAKAA.AA.DE | A..A........ | 0.01 | 1 |
| GT... | F......GG.NA.I...R | ..ADH....DF......T | ...D.R | E.TS.GD.A.GD | A..A........ | 0.01 | 1 |
| R...T | .................. | TKDDR....DF....... | ...DDR | EDTG.A....GN | A..A........ | 0.01 | 1 |
| G...T | .................. | .................. | ...DDR | .......... | A..A........ | 0.01 | 1 |
| DT... | F......N..IL.T.T.R | ..HG.....NF......T | ...A.. | .......... | THKNG..SGE.T | 0.01 | 1 |
| RA... | F.....STG.LQ.L.D.R | .PDNR..T.DF......T | ....GR | .......... | A..A........ | 0.01 | 1 |
| ..... | F................. | .V........F....... | ...... | .......... | GPRAA..YTT.D | 0.01 | 1 |
| NT... | .................. | ..PNG....DF....... | R..AGR | .SGGRS..E.DQ | A..A........ | 0.01 | 1 |
| ..... | .................. | .................. | ...DD. | ..GAGSD.AY.D | A..A........ | 0.01 | 1 |
| ..... | F.....DTG.SK.T.T.R | .Q.S......F....... | ...D.. | .NGR.G..A..E | A..A........ | 0.01 | 1 |
| T.... | F......SA.IN.L.N.H | .QD.E....NF....... | ...... | .DAGGND.A.D. | A..A........ | 0.01 | 1 |
| NA... | F.....SRG.PV.P.N.R | .................. | ...... | .......... | A..A........ | 0.01 | 1 |
| D...T | F................. | .................. | R..DD. | .......... | ............ | 0.01 | 1 |
| EA... | F.....ASA.S..T.T.G | .QPG.....DF....... | ...DDR | .......... | ............ | 0.01 | 1 |
| ..... | F................. | .V........F....... | ...... | .......... | TSRDT..NNK.E | 0.01 | 1 |
| SA... | F................. | .V........F....... | ...... | .......... | ASSNH..AKG.D | 0.01 | 1 |
| GT... | F................. | ...GG....NF....... | E..AD. | .......... | A..A........ | 0.01 | 1 |
| ..... | F................. | .V........F....... | ...... | .......... | NPRG...DNG.D | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| R.... | ................. | .KPDQ.....F....... | ....GR | EDTG.A....GN | A..A........ | 0.01 | 1 |
| ..... | ................. | ................. | ...... | ES.SA..I..DR | A..A........ | 0.01 | 1 |
| D.... | F.....G..NQ.N.D.K | ...TE....F.......T | E..KD. | ........... | A..A........ | 0.01 | 1 |
| ..... | ................. | ................. | R...D. | .DAGRND.EFD. | ........... | 0.01 | 1 |
| D...T | F.....ASA.S..T.T.G | .QPG....DF....... | ...DDR | ........... | ........... | 0.01 | 1 |
| GA... | ................. | .Q......DF....... | ...AD. | .DGARDDAA..D | A..A........ | 0.01 | 1 |
| A.... | ................. | ................. | ...... | E.ARAN...F.N | A..A........ | 0.01 | 1 |
| E.... | F.....GT..NQ.K.G.R | .QHNQ.....F......T | ...N.. | ........... | A..A........ | 0.01 | 1 |
| E.... | F................ | ................. | ...DDR | ........... | ........... | 0.01 | 1 |
| ..... | ................. | T.A.H....DF....... | ...DD. | ENGREG.AA..H | A..A........ | 0.01 | 1 |
| ..... | ................. | ..DGE....DF....... | R...D. | ........... | GARNA..AEG.E | 0.01 | 1 |
| ..... | ................. | ................. | G..ND. | E.T..S..A..H | A..A........ | 0.01 | 1 |
| ..... | ................. | ................. | E..ND. | E.TGRND.A..E | A..A........ | 0.01 | 1 |
| E.... | ................. | .KD.E.....F..P...T | R..ND. | ........... | A..A........ | 0.01 | 1 |
| ..... | ................. | ................. | ...... | .STA..DA.FDS | A..A........ | 0.01 | 1 |
| GA... | F.....GDT.H..I...G | .QAS......F....... | ...D.. | ........... | A..A........ | 0.01 | 1 |
| TA... | ................. | ................. | ...D.. | ........... | A..A........ | 0.01 | 1 |
| ..... | ................. | ................. | ...DD. | ........... | KDRAA..VHN.H | 0.01 | 1 |
| G.... | ......A.......... | .........NF......T | ....D. | EN.GR.D.E.GE | A..A........ | 0.01 | 1 |
| ..... | ................. | ................. | ...... | E.AGGS..AVDG | A..A........ | 0.01 | 1 |
| ..... | F.....NNA..K...K.. | .QPN......F......T | ...N.. | ........... | A..A........ | 0.01 | 1 |
| ..... | F.....AEG.NI.L.K.R | .QD.E.....F..P.... | ...... | E.TKTN.AAVDE | A..A........ | 0.01 | 1 |
| D.... | F.....NKT.HL.T.A.R | .QANH.....F......T | ...DDR | .SGKTADAEVGD | A..A........ | 0.01 | 1 |
| ..... | ................. | .........NF......T | R..DD. | EDAKGS.A..DH | A..A........ | 0.01 | 1 |
| ..... | ................. | F................ | ...... | ED.GAG..AV.G | A..A........ | 0.01 | 1 |
| .A... | F.....AST.HD.T.E.R | T.P.....DF....... | ...DG. | ........... | ........... | 0.01 | 1 |
| TA... | ................. | .................T | ...NDR | E.TGAN.AE.GE | A..A........ | 0.01 | 1 |
| TA... | F.....NGG.NN.K.T.R | .KYT....NF......T | ...... | ........... | A..A........ | 0.01 | 1 |
| ..... | ................. | .........NF...... | ...DDR | ........... | ARSNR..FDV.H | 0.01 | 1 |
| GT... | ................. | ................. | ...ND. | ESTRG..I..GD | A..A........ | 0.01 | 1 |
| TA... | ................. | .................T | ...D.. | ........... | ........... | 0.01 | 1 |
| .A... | ................. | ................. | ...... | EN.TR.DAA.DE | A..A........ | 0.01 | 1 |
| RT... | F.....AEG.NI.L.K.R | .KP......NF....... | ..D.. | ..TGGSD.A.DN | A..A........ | 0.01 | 1 |
| ..... | ................. | .PPNG....F......T | ...DDR | ........... | A..A........ | 0.01 | 1 |
| ..... | ................. | .QPG.....DF....... | ...DDR | ..AKG.D.AYDG | A..A........ | 0.01 | 1 |
| G.... | F................ | .V........F....... | ...... | ........... | GHRNG..D.N.E | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ................. | E..KDR | .DADA.D.A.DR | A..A........ | 0.01 | 1 |
| ..... | ................. | .........DF..P.... | G..K.. | ........... | A..A........ | 0.01 | 1 |
| ..... | F.....SN..PL.K.T.. | ..ADG.....F......T | ....D. | ........... | ........... | 0.01 | 1 |
| D.... | F.....GKG.ND.T.N.G | ................. | ...... | ........... | A..A........ | 0.01 | 1 |
| ..... | ................. | ................. | ...DG. | ........... | ........... | 0.01 | 1 |
| TA... | ................. | .QPSQ....NF....... | E..TGR | E.TD.A....DG | A..A........ | 0.01 | 1 |
| ..... | ................. | F................ | E..DDR | ...GRDDI..DR | A..A........ | 0.01 | 1 |
| PA..T | ................. | ................. | E..NG. | ........... | ........... | 0.01 | 1 |
| ..... | F................ | .V........F....... | ...... | ........... | DRKDT...NN.A | 0.01 | 1 |
| RA... | F.....GKG.S..M.K.M | .Q.S......F....... | R..DD. | ESGTRGD..VGQ | A..A........ | 0.01 | 1 |
| NA..T | ................. | TQASG....NF....... | ....D. | E.AS...IEYGQ | A..A........ | 0.01 | 1 |
| ..... | ................. | ................. | ...D.. | .N.TAN...VGS | A..A........ | 0.01 | 1 |
| GT... | F.....SRG.HP.H.D.G | ..A......DF....... | R..AGR | EDAGT...AFD. | A..A........ | 0.01 | 1 |
| ..... | F......S..PM.T.S.K | ..DGE....DF....... | ...... | ........... | ........... | 0.01 | 1 |
| ..... | ................. | .V........F....... | ...... | ........... | DPRGG..VQK.A | 0.01 | 1 |
| ..... | ................. | T.HTE....NF......T | ...NDR | ........... | A..A........ | 0.01 | 1 |
| ..... | ................. | ................. | ....D. | ENA.GAD..... | A..A........ | 0.01 | 1 |
| ..... | F................ | .V........F....... | ...... | ........... | GPRST..D.E.Q | 0.01 | 1 |
| ..... | ................. | ...TE.....F......T | R..DD. | ........... | A..A........ | 0.01 | 1 |
| AA... | F.....S.A.N..L...L | .KYT....NF.......T | ....GR | ENAG.SD.E..H | A..A........ | 0.01 | 1 |
| AA... | F......S..PM.T.S.K | .Q.GQ....DF....... | ....G. | ........... | A..A........ | 0.01 | 1 |
| AA... | ................. | TQPT......F....... | ...N.. | ...AAA.IE..Q | A..A........ | 0.01 | 1 |
| ..... | ................. | TKHGG....NF......T | ...... | ........... | A..A........ | 0.01 | 1 |
| ..... | F................ | ................. | ....D. | ........... | A..A........ | 0.01 | 1 |
| G...T | ......NS..II...A.R | ...TE.....F......T | ...DD. | .N.SGNDIE.DQ | A,.A........ | 0.01 | 1 |
| ..... | ................. | ................. | ....D. | .NTGGG.....H | A..A........ | 0.01 | 1 |
| ..... | ................. | ................. | R..DD. | ..TNESD..... | A..A........ | 0.01 | 1 |
| GT..T | F.....ARG.NA.P.Q.I | ...DG....DF....... | E..KD. | ENASG.....GN | A..A........ | 0.01 | 1 |
| ..... | ................. | ................. | R...D. | .DTSTN..E..G | A..A........ | 0.01 | 1 |
| .A... | F.....NAG.P..T.T.M | .KAS.....NF....... | ...DDR | ........... | A..A........ | 0.01 | 1 |
| ..... | ......ASA.S..T.T.G | .QPG.....DF....... | ...DDR | ........... | ........... | 0.01 | 1 |
| ..... | F................ | .V........F....... | ...... | ........... | SPRAT..VKG.D | 0.01 | 1 |
| DT... | F......N..IL.T.T.R | .........NF....... | R...D. | E.AR...I..DE | A..A........ | 0.01 | 1 |
| ..... | ................. | T.P......DF....... | ...DD. | .NTRRGDIE..D | A..A........ | 0.01 | 1 |
| ..... | ................. | .................T | ...... | ..T......... | A..A........ | 0.01 | 1 |
| ....T | F.....DTT.LH.K.T.G | .........NF....... | R...D. | ........... | A..A........ | 0.01 | 1 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F................ | .................. | R...D. | .DAKGD.A.F.D | A..A........ | 0.01 | 1 |
| GA... | F.....DNA.NA.M.N.K | ..HG.....NF......T | ...DD. | ............ | A..A........ | 0.01 | 1 |
| DA... | ................ | .................. | ...DDR | ..ARGADAE..S | A..A........ | 0.01 | 1 |
| GA... | F.....DQG.S..L...G | .Q.DR.....F....... | ....D. | ............ | A..A........ | 0.01 | 1 |
| E.... | F................ | .V........F....... | ...... | ............ | GTRDG..AE..A | 0.01 | 1 |
| .A... | ................ | ...G.....DF....... | R..DD. | ............ | A..A........ | 0.01 | 1 |
| SA..T | F.....GNG.HV.H.G.R | .................. | ...... | ............ | A..A........ | 0.01 | 1 |
| ..... | F................ | .V........F....... | ...... | ............ | AP.GR...QI.D | 0.01 | 1 |
| TA..T | F.....AEG.LK.M.H.L | ..DGE...DF....... | ...... | ............ | ............ | 0.01 | 1 |
| A.... | F.....DGG.NL.....N | TKDDR....DF....... | ...DDR | ............ | A..A........ | 0.01 | 1 |
| ..... | ................ | .Q.DR.....F....... | ....D. | ..GGA.D.E.GN | A,.A........ | 0.01 | 1 |
| GT... | F.....AEG.LK.M.H.L | ..DGE....DF....... | ....D. | ............ | ............ | 0.01 | 1 |
| SA... | F.....G.G..H.L.H.L | TQ.TQ.....F......T | ...D.R | E.AGAND.AY.N | A..A........ | 0.01 | 1 |
| ..... | F................ | .V........F....... | ...... | ............ | K.SGG..NTE.T | 0.01 | 1 |
| ..... | ................ | .KDSR....DF....... | E..ND. | ............ | A..A........ | 0.01 | 1 |
| AT..T | ................ | .................. | E..TG. | .SA.TG.A..GQ | A..A........ | 0.01 | 1 |
| G...T | F.....AEG.LK.M.H.L | ..DGE....DF....... | ...... | ............ | ............ | 0.01 | 1 |
| ..... | ................ | .................. | R...D. | ESA..S.AA..R | A..A........ | 0.01 | 1 |
| E...T | F.....AEG.LK.M.H.L | ..HG.....NF......T | E..DD. | ............ | ............ | 0.01 | 1 |
| TT... | F.....A.G..V.T.H.R | .Q.DR.....F....... | ....D. | E..AGS.AA.DN | A..A........ | 0.01 | 1 |
| ..... | F.....SG..IK.K.D.R | .................T | ...... | ...DTN..E.DR | A..A........ | 0.01 | 1 |
| ..... | ...........M..... | .................. | ...NDR | ..AKG...AV.. | A..A........ | 0.01 | 1 |
| E.... | ................ | .V........F....... | ...... | .DAAGA.IE.GN | A,.A........ | 0.01 | 1 |
| R.... | F.....AQ...A.L.... | .PPNG.....F......T | ...DDR | ..AST..AA..D | A..A........ | 0.01 | 1 |
| EA... | ................ | .QANH....DF....... | ...DDR | ............ | ............ | 0.01 | 1 |
| .A... | .......KT.NV.K.T.H | .Q.......DF....... | G..TG. | ............ | A..A........ | 0.01 | 1 |
| G...T | F.....GHG.NK.I.N.R | TQ.TG....DF....... | ...... | ..GGG.D.E... | A..A........ | 0.01 | 1 |
| ..... | ................ | T.P......DF....... | ...DG. | .SG..ND...DG | A..A........ | 0.01 | 1 |
| A...T | ......AEG.LK.M.H.L | ..DGE....DF....... | ...... | ............ | ............ | 0.01 | 1 |
| GT... | ................ | .................. | ...DDR | EN.DAS...V.E | A..A........ | 0.01 | 1 |
| ..... | F................ | .V........F....... | ...... | ............ | GAHAH..F.E.. | 0.01 | 1 |
| D...T | F.....N.G.PL.K.P.R | .Q.DR.....F....... | ....D. | ............ | A..A........ | 0.01 | 1 |
| ..... | F................ | .V........F....... | ...... | ............ | SNST...YHV.E | 0.01 | 1 |
| ..... | ................ | .................. | ...... | .NAGASDA.FDQ | A..A........ | 0.01 | 1 |
| ..... | F.....SRG..L.P.G.G | ..HG.....NF......T | .....R | ............ | A..A........ | 0.01 | 1 |
| ..... | ................ | TQASG....NF....... | ....D. | E.AS...IEYGQ | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F.....DQ..R..P.S.R | TQYDR....NF....... | R...D. | ............ | A..A........ | 0.01 | 1 |
| ..... | ......GRT..L.H.E.S | .V........F....... | ...... | ............ | A..A........ | 0.01 | 1 |
| ..... | ................ | ..PNG....DF......T | ...ADR | E.AG.D...YGR | A..A........ | 0.01 | 1 |
| ..... | ................ | ................ | ...DDR | .DANTN.A.VDS | A,.A........ | 0.01 | 1 |
| ..... | F................ | T.P......DF....... | R...D. | ............ | A,.A........ | 0.01 | 1 |
| G.... | F................ | .V........F....... | ...... | ............ | ETRSE..YDE.. | 0.01 | 1 |
| ..... | ................ | ........DF....... | ...DDR | .DGSGG.TE.DG | A..A........ | 0.01 | 1 |
| ....T | F......AG.NV.N.S.R | .QAS.....NF......T | ...N.. | ............ | A..A........ | 0.01 | 1 |
| E...T | ................ | ..DGE....DF..K...T | ...AG. | .D.GA.DIE.DR | A,.A........ | 0.01 | 1 |
| AT... | F.....ATG.NV.T.G.R | .Q.DR.....F....... | ....D. | ............ | GQKDR..ST..H | 0.01 | 1 |
| .A... | F................ | .QD.E.....F..P.... | ...D.. | ............ | ............ | 0.01 | 1 |
| ..... | ................ | ................ | ...DDR | ............ | GAQTR..SKE.H | 0.01 | 1 |
| TT... | ................ | .V........F....... | ...... | E.AGT.DTEY.Q | A..A........ | 0.01 | 1 |
| ..... | F.....NA..RM.M.K.. | ..DGE....DF....... | ...DDR | ............ | ............ | 0.01 | 1 |
| SA... | ................ | ........NF......T | ...N.. | ..TG.A.I..GR | A..A........ | 0.01 | 1 |
| TA... | F.....DE..PN.T.G.K | ..PNG....DF....... | R..AGR | ESGS.S.IA.DQ | A..A........ | 0.01 | 1 |
| ..... | ................ | ................ | R..NG. | .DANRN..E.GQ | A..A........ | 0.01 | 1 |
| RA..T | F.....AGA.NK.L...K | .KYT.....NF......T | ...... | ............ | A..A........ | 0.01 | 1 |
| ..... | ................ | ...GG.....F....... | R..D.. | ............ | A..A........ | 0.01 | 1 |
| TT..T | ................ | ................ | .....S | ............ | ............ | 0.01 | 1 |
| TA... | F.....NKT.HL.T.A.R | TQDS.....NF....... | ...... | E.GT.ND.A.DG | A..A........ | 0.01 | 1 |
| GT... | F.....DKG.HM.L.G.R | ........DF....... | ...... | ............ | A..A........ | 0.01 | 1 |
| ..... | ................ | ..HG.....NF......T | ...A.. | EDAG.AD.E.G. | A..A........ | 0.01 | 1 |
| ..... | ................ | ................ | ...N.. | ............ | DPRGG..VQK.A | 0.01 | 1 |
| ..... | F................ | .V........F....... | ...... | ............ | THKNG..SGE.T | 0.01 | 1 |
| ..... | ................ | ........NF......T | ...DDR | EDAS....A.GQ | A..A........ | 0.01 | 1 |
| ..... | ................ | .R........F......T | ...DDR | E..AGS.TEFDQ | A..A........ | 0.01 | 1 |
| ..... | ................ | ................ | ...DDR | ESTGGND.EYDQ | ............ | 0.01 | 1 |
| .A... | F.....SN..PL.K.T.. | TKHGG....NF......T | ...... | ............ | A..A........ | 0.01 | 1 |
| ..... | ................ | ................ | ...... | EDASG....FDR | A..A........ | 0.01 | 1 |
| .A... | F.....AGG.P..L...G | .QAS......F....... | ...... | ............ | A..A........ | 0.01 | 1 |
| ..... | F................ | .QPG.....DF....... | ...DDR | ............ | ............ | 0.01 | 1 |
| AA..T | F................ | .QANH....DF....... | ...DDR | ............ | A..A........ | 0.01 | 1 |
| TA... | ................ | .V........F....... | ...... | ............ | G.KAH..DRS.. | 0.01 | 1 |
| ..... | ................ | ........F......T | ....GR | ...RGND..V.E | A..A........ | 0.01 | 1 |
| ..... | ...............R | .KDDG....NF....... | R..DD. | ..AT.DD..FDG | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ................. | ...DDR | ENAGGD..E..R | A..A........ | 0.01 | 1 |
| RA... | F.....SK..PA.K.A.G | ..DGE....DF....... | ...... | E.DR.S..EVGE | A..A........ | 0.01 | 1 |
| ..... | F.....STA..Q.H.Q.L | TK.NE....DF....... | ...... | .N.AE...E.DG | A..A........ | 0.01 | 1 |
| G...T | F.....AEG.LK.M.H.L | ..DGE....DF......T | ...... | ............ | ............ | 0.01 | 1 |
| ..... | F................. | ...T.....NF....... | ...... | ............ | A..A........ | 0.01 | 1 |
| E.... | ................. | ................. | R..DD. | EN.KAN....GG | A..A........ | 0.01 | 1 |
| ..... | ................. | .........NF....... | ...DDR | EDAG...I..GQ | ............ | 0.01 | 1 |
| ..... | ................. | .V........F....... | ...DDR | H........... | ............ | 0.01 | 1 |
| GA... | ................. | ................. | ...... | ..TAGN..A..N | A..A........ | 0.01 | 1 |
| ..... | ................. | ................. | R...D. | ...SRA..A.GG | A..A........ | 0.01 | 1 |
| AT... | F.....GN..NK.P.P.N | .Q.S......F....... | ...DD. | ............ | A..A........ | 0.01 | 1 |
| ..... | F................. | .QPG.....NF....... | ...DD. | E.GGA.D.E..G | A..A........ | 0.01 | 1 |
| T.... | F.....NTG.LH.T...R | .Q.S......F......T | R...D. | E.GRGA..AV.E | A..A........ | 0.01 | 1 |
| ..... | ................. | ................. | ...A.. | .NAG.DD...DQ | A..A........ | 0.01 | 1 |
| .A... | F.....NA..HE.L.G.R | T.P......DF....... | ...D.. | ............ | ............ | 0.01 | 1 |
| ..... | ................. | .KAS.....NF......T | ...AG. | ............ | A..A........ | 0.01 | 1 |
| G.... | ................. | ..............P...T | G..ND. | ............ | A..A........ | 0.01 | 1 |
| RT... | ................. | ................. | ...DDR | ............ | A..A........ | 0.01 | 1 |
| ..... | F.....SGT.S..P.A.K | T.PG.....NF....... | ...DDR | ............ | A..A........ | 0.01 | 1 |
| .A... | F................. | .V........F....... | .Y.... | ............ | KH.SS..SGN.T | 0.01 | 1 |
| ..... | ................. | .........DF....... | ...DDR | E.GD.A..E.GQ | A..A........ | 0.01 | 1 |
| ..... | F................. | ..AGQ....NF....... | ...... | ..AG.DDIA.DN | A..A........ | 0.01 | 1 |
| ..... | ................. | ................. | R...D. | ..AAGSDIE..E | A..A........ | 0.01 | 1 |
| ..... | ................. | .Q.......DF....... | ...AD. | E.GNGS....GR | A..A........ | 0.01 | 1 |
| ..... | ................. | ................. | R...D. | EDAGAA..EFGQ | A..A........ | 0.01 | 1 |
| ..... | F.....SAG..L.H...K | T.PNE....DF....... | R...D. | ............ | ............ | 0.01 | 1 |
| ..... | ................. | ........F......T | ...ADR | ............ | A..A........ | 0.01 | 1 |
| ..... | ................. | ................. | ...D.. | ...RRND...DR | A..A........ | 0.01 | 1 |
| ..... | ................. | ................. | G..ND. | ............ | A..A........ | 0.01 | 1 |
| ..... | ................. | ................. | E..DD. | .SAS.N.IA..E | A..A........ | 0.01 | 1 |
| ..... | ................. | .......D......... | E..NG. | ............ | ............ | 0.01 | 1 |
| ..... | F................. | .........DF....... | ...D.R | ............ | ............ | 0.01 | 1 |
| ..... | ................. | .........NF....... | E..KG. | ............ | A..A........ | 0.01 | 1 |
| D...T | F......GT.NM.L.Q.G | .Q.S......F....... | ....D. | E.ADRAD.A..G | A..A........ | 0.01 | 1 |
| .A... | F.....SD..R..P.T.L | ..DGE....DF....... | R...D. | ............ | A..A........ | 0.01 | 1 |
| ..... | F.....GS..NM.N.E.R | .QPN......F......T | ...N.. | ............ | A..A........ | 0.01 | 1 |

TABLE 3-continued

AAV capsid proteins having increased specificity for and/or transduction of CD447−/133− GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| D.... | F.....NGG.NN.K.T.R | .Q.DR.....F....... | ....D. | .DAGA.D.A.GE | A..A........ | 0.01 | 1 |
| ..... | F.....SN..PL.K.T.. | ..........F..P.... | R..... | ........... | ............ | 0.01 | 1 |
| A.... | F.....DA..IA.L.K.R | .Q.GQ....DF....... | ....G. | ........... | A..A........ | 0.01 | 1 |
| G.... | .................. | .................. | ...NGR | E.AK.N..AFDG | A..A........ | 0.01 | 1 |
| ..... | F................. | .V........F....... | ...... | ........... | SSRNG...DV.Q | 0.01 | 1 |
| E.... | F......TG.RL.T.K.N | ..DGE....DF....... | ...... | ........... | A..A........ | 0.01 | 1 |
| G.... | .................. | .................. | ...... | E.A.RA.IE.D. | A..A........ | 0.01 | 1 |
| ..... | .................. | .PPNG.....F......T | ...DDR | E.TS.D..AFDQ | A..A........ | 0.01 | 1 |
| ..... | F................. | .V........F....... | ...... | ........... | GERTG..SRA.E | 0.01 | 1 |
| GT... | .................. | .................. | ...... | ........... | ANRS....R..H | 0.01 | 1 |
| ..... | F................. | .V........F....... | ...... | ........... | GPRGR..YE... | 0.01 | 1 |
| GA... | .................. | .Q.......NF....... | ...AD. | E.AGE...E..N | A..A........ | 0.01 | 1 |
| ..... | .................. | .................. | ...... | ...AAS.A.VGQ | A..A........ | 0.01 | 1 |
| ..... | F................. | .V........F....... | ...... | ........... | S.KNS..I...Q | 0.01 | 1 |
| D.... | ......SSG.II.H.D.R | .........NF....... | R...D. | ........... | A..A........ | 0.01 | 1 |
| RT... | F.....DEG.SI.L...L | ..DGE....DF....... | ...... | .SAKAA.AA.DE | A..A........ | 0.01 | 1 |
| NA... | F................. | T.PTG....DF....... | ...DDR | .SAKAA.AA.DE | ............ | 0.01 | 1 |
| ..... | F................. | .V........F....... | ...... | ........... | GPKNP..ADM.T | 0.01 | 1 |
| ..... | .................. | ....E............. | ...NDR | ..AKG...AV.. | A..A........ | 0.01 | 1 |
| EA... | F.....DH..ID.K...V | TQ.TG....DF....... | ...DDR | ENAGGG...YDQ | A..A........ | 0.01 | 1 |
| ..... | F.....A.G..V.T.H.R | .QPN......F......T | ...N.. | ........... | A..A........ | 0.01 | 1 |
| R.... | F......KT.NV.K.T.H | .QDT.....DF....... | G..DG. | ........... | A..A........ | 0.01 | 1 |
| ..... | F......QG.NQ...A.R | .KDSR....DF....... | ....D. | E.AK.SD.AYDE | ............ | 0.01 | 1 |
| ..... | F................. | .V........F....... | ...DG. | ........... | A..A........ | 0.01 | 1 |
| TT..T | F................. | .............P.... | ...... | ..TRRD.A.FDG | A..A........ | 0.01 | 1 |
| E.... | F.....DGT..I.H.S.R | .Q.S......F....... | R..DD. | ........... | A..A........ | 0.01 | 1 |
| ..... | .................. | .KTSADNN...NF.GATK | R..DD. | ........... | ............ | 0.01 | 1 |
| D...T | F.....GRT.S..L.G.R | .................. | ...... | .DGNAS....DR | A..A........ | 0.01 | 1 |
| AT... | F.....AEG.LK.M.H.L | ..DGE....DF....... | ...... | ........... | ............ | 0.01 | 1 |
| TT..T | .................. | .................. | R..DD. | ........... | ............ | 0.01 | 1 |
| ..... | .................. | T.A.Q....DF....... | ...DDR | ..AG.N.AA.GQ | A..A........ | 0.01 | 1 |
| KA... | .................. | TQ.TG....DF....... | ...... | ..ARAA.I..GQ | A..A........ | 0.01 | 1 |
| DA..T | F.....SH..PV.L.G.G | .QDT.....DF....... | G..DG. | ........... | ............ | 0.01 | 1 |
| T.... | F.....DGA.R..P.A.K | .........NF....... | R...D. | ........... | A..A........ | 0.01 | 1 |
| .A... | .................. | .KDDG....DF......T | ....GR | ESGGEN.AE..H | A..A........ | 0.01 | 1 |
| ..... | .................. | .................. | ...DDR | ..GTTG....GR | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | .QAS......F....... | ...... | ENGTASD.AF.E | A..A........ | 0.01 | 1 |
| ..... | .................. | .................. | ...N.. | ESGG.G..E..Q | A..A........ | 0.01 | 1 |
| ..... | .................. | .................. | ...D.R | ..TG.D..A.GG | A..A........ | 0.01 | 1 |
| ..... | .................. | .................. | ....GR | ...NRG.IA.DE | A..A........ | 0.01 | 1 |
| .A... | F.....DRG.S..T.A.S | ........DF....... | ...DDR | ........... | A..A........ | 0.01 | 1 |
| NA..T | .................. | .QLG.....NF....... | ...DD. | .DARAADA...Q | A..A........ | 0.01 | 1 |
| GT... | .................. | T.P.....DF....... | ...D.. | .SGT.GD.AVGE | A..A........ | 0.01 | 1 |
| EA..T | F......KG.S..T.P.K | ........NF....... | ...... | ........... | A..A........ | 0.01 | 1 |
| EA..T | F.....GS..NA.T...M | .................. | G..ND. | ........... | A..A........ | 0.01 | 1 |
| ..... | .................. | TKDDR....DF....... | ...DDR | ........... | A..A........ | 0.01 | 1 |
| TA... | F.....SG..IK.K.D.R | .QPG.....NF....... | ...... | ..ATAA..AVDN | A..A........ | 0.01 | 1 |
| ..... | .................. | .................. | R..DD. | EDAG...I..GQ | A..A........ | 0.01 | 1 |
| D...T | F................. | .V........F....... | ...... | ........... | GAHNN..FDV.A | 0.01 | 1 |
| SA... | .................. | .PPNG.....F......T | ...DDR | ........... | GRKTG..AEV.A | 0.01 | 1 |
| ..... | .................. | ....N............. | R..NDR | E.AG..D.A.GR | A..A........ | 0.01 | 1 |
| KA... | F.....NGT.IL.T.A.K | .QAS.....NF......T | ....GR | ........... | A..A........ | 0.01 | 1 |
| NA... | .................. | TQ.TG....DF....... | ...DDR | .NAGASDA.FDQ | A..A........ | 0.01 | 1 |
| SA... | F.....GN..NA.T...M | .Q.GQ....DF....... | ...DDR | E.TGAN.AE.GE | A..A........ | 0.01 | 1 |
| GA... | F.----GRG.N......H | .Q.S......F....... | E..N.. | ........... | A..A........ | 0.01 | 1 |
| R.... | .................. | .KD.E....DF....... | ...DDR | ES.A.S..EFDS | A..A........ | 0.01 | 1 |
| GT... | .................. | .................. | ...DDR | .NAT.A.A.FGD | A..A........ | 0.01 | 1 |
| A...T | F.....SGT.SQ.K.E.. | .KYT.....NF......T | E..TD. | ........... | A..A........ | 0.01 | 1 |
| DT... | F.....ARA.L..L.Q.G | ..DGE....DF....... | ...D.. | ........... | A..A........ | 0.01 | 1 |
| ..... | .................. | .................. | E..AD. | ENGGGA.I..GQ | A..A........ | 0.01 | 1 |
| AA... | .................. | .................. | E..N.. | ........... | A..A........ | 0.01 | 1 |
| TA... | F.....SRG.PV.P.N.R | .QDT.....DF....... | G..DG. | ..AG..DIAF.G | A..A........ | 0.01 | 1 |
| ..... | .................. | .................. | G..ND. | E.GGRGD....G | A..A........ | 0.01 | 1 |
| T.... | .................. | .................. | R...D. | ..AG.DD...GG | A..A........ | 0.01 | 1 |
| N.... | F.....SA..SM.M.T.K | .QAS......F....... | ...... | E....ND.EF.Q | A..A........ | 0.01 | 1 |
| ..... | .................. | ...............T | ....D. | .NGST.....GG | A..A........ | 0.01 | 1 |
| EA... | F.....GRG.H..P.E.R | .V........F....... | R..DD. | ........... | A..A........ | 0.01 | 1 |
| A.... | F.....SRG.PV.P.N.R | ..AGR....DF......T | ...D.. | ........... | A..A........ | 0.01 | 1 |
| .A... | F................. | .QANH....DF....... | ...DDR | ........... | A..A........ | 0.01 | 1 |
| ..... | .................. | .................. | ...D.. | E.TGTA.AEVGE | A..A........ | 0.01 | 1 |
| ..... | .................. | .................. | ...A.. | .D.TR..AA..Q | A..A........ | 0.01 | 1 |
| ..... | .................. | .QPSQ....NF....... | ....GR | ........... | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F.....ARA.L..L.Q.K | .QHNQ.....F......T | ...D.. | E.AG.GD.EY.. | A..A........ | 0.01 | 1 |
| ..... | ................. | .........NF....... | ...NDR | E.AGAA..E.DR | A..A........ | 0.01 | 1 |
| KA... | ................. | ................. | .....S | E.AS.A.TAV.H | A..A........ | 0.01 | 1 |
| ..... | F.....G.G.RA.N.E.R | .QDT......F......T | ...D.. | EDAGT...AFD. | A..A........ | 0.01 | 1 |
| ..... | F.....DKG.HM.L.G.R | ...TE....NF......T | ...NGR | ............ | A..A........ | 0.01 | 1 |
| T.... | ................. | .V........F....... | ...ADR | EDGDGA..A.DR | A..A........ | 0.01 | 1 |
| GT... | F.....GRG.SE.N.P.H | .V........F....... | ...... | EDAG...I..GQ | A..T........ | 0.01 | 1 |
| ..... | F................ | .K.TG....DF....... | R...DR | ..ATRS.I..GN | A..A........ | 0.01 | 1 |
| ..... | ................. | ................. | R...D. | ESAAGD.IE.GD | A..A........ | 0.01 | 1 |
| ..... | ................. | ................. | ...N.. | ............ | E..A........ | 0.01 | 1 |
| ..... | ................. | ................. | ...DDR | ..AS...I..G. | A..A........ | 0.01 | 1 |
| E.... | ................. | .V........F....... | ...... | ............ | NAKTR..FTT.D | 0.01 | 1 |
| ..... | ................. | ................. | E..KD. | .DTGGA.I..GQ | A..A........ | 0.01 | 1 |
| E.... | ................. | .V........F....... | ...... | ............ | NAKTR..FTT.D | 0.01 | 1 |
| ..... | ................. | ................. | E..KD. | .DTGGA.I..GQ | A..A........ | 0.01 | 1 |
| R.... | F.....DE..PK.L.A.R | TQ.TG....DF....... | ...DDR. | ............ | A..A........ | 0.01 | 1 |
| ..... | ................. | ................. | E..DDR | ............ | A..A........ | 0.01 | 1 |
| DT... | F.....SKT.LV.M.T.G | .K.TG....DF....... | R...DR | ............ | A..A........ | 0.01 | 1 |
| RA... | ................. | TKDT.....NF....... | ...... | ............ | A..A........ | 0.01 | 1 |
| ..... | ................. | ................. | ...D.R | E.T..S..A..R | A..A........ | 0.01 | 1 |
| ..... | F.....NKT.I..K.... | .Q.DR.....F....... | G..ND. | ............ | A..A........ | 0.01 | 1 |
| R.... | ................. | .KDSR....DF....... | ....D. | EDGGRG...V.D | A..A........ | 0.01 | 1 |
| ..... | ................. | ..........F......T | G..NDR | ............ | A..A........ | 0.01 | 1 |
| ..... | ................. | ..DNH....NF......T | E..ND. | ............ | A..A........ | 0.01 | 1 |
| ..... | ................. | ................. | ...... | .DG.RA...V.R | A..A........ | 0.01 | 1 |
| T...T | F......GA.HP.K...V | T.P......DF....... | ...D.. | ............ | A..A........ | 0.01 | 1 |
| TA... | F.....GGG.HK.T...G | .V........F....... | ....D. | E.T..S..A..R | A..A........ | 0.01 | 1 |
| E...T | F.....AQG.SN.K.G.K | ..DGE....DF....... | ...... | E.AGE...E..N | A..A........ | 0.01 | 1 |
| RA... | ................. | TQ.TG....NF....... | ...DDR | E.AGG.DI..GH | A..A........ | 0.01 | 1 |
| ..... | ................. | ..YN............. | ...... | ED.GG...E.GR | A..A........ | 0.01 | 1 |
| T.... | F.....A.A.NH.I.Q.G | .QAS......F....... | R..DD. | ............ | A..A........ | 0.01 | 1 |
| ..... | F................ | .V........F....... | ...... | ............ | GKSGH..ARE.A | 0.01 | 1 |
| ..... | ................. | ................. | G..N.. | E.AGTNDI...R | A..A........ | 0.01 | 1 |
| N.... | ................. | .KPSE....DF......T | R...DR | E.AG.ADIE.G. | A..A........ | 0.01 | 1 |
| E.... | F................ | ................. | ...ADR | .DTSAND.A.DE | A..A........ | 0.01 | 1 |
| A.... | F.....AR..SL...H.G | .Q.DR.....F....... | ....D. | ..AATD.AA.DQ | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ................. | E...N. | ............ | A..A........ | 0.01 | 1 |
| RA... | ................. | .Q.S......F......T | G..A.R | ............ | A..A........ | 0.01 | 1 |
| ..... | ................. | TKAT.....NF | ...... | ............ | A..A........ | 0.01 | 1 |
| D...T | F.....DAT..L.I.N.R | T.ADG....NF......T | R..N.. | ............ | A..A........ | 0.01 | 1 |
| SA... | F.....SGT.S..T.T.. | .K.T......F | R..AD. | ............ | A..A........ | 0.01 | 1 |
| ..... | F................. | ................. | ...DD. | E.T..S..A..R | A..A........ | 0.01 | 1 |
| ..... | ................. | ................. | ...... | .NAT.ND.AFGE | A..A........ | 0.01 | 1 |
| RA..T | F.....SG..IK.K.D.R | T.A.Q....DF....... | G..A.R | ............ | A..A........ | 0.01 | 1 |
| ..... | F.....SA..RA.....R | TKDDR....DF....... | ...DDR | ............ | A..A........ | 0.01 | 1 |
| ..... | F................. | .V........F....... | ...... | ............ | G.RSG..VR..H | 0.01 | 1 |
| TA..T | F.....SET.NN.P.H.L | .Q.DR.....F....... | ....D. | E.ANG...E.G. | A..A........ | 0.01 | 1 |
| .A... | ................. | ..YN......F......T | ...D.R | E.TGRA..A..R | A..A........ | 0.01 | 1 |
| N.... | ................. | ..HGG.....F......T | ...... | ES.TRSDI.FDH | A..A........ | 0.01 | 1 |
| ..... | F................. | .V........F....... | ...... | ............ | SRRDP..NDG.. | 0.01 | 1 |
| T.... | F.....GRG.R..P.T.L | ...DG....DF....... | E..KD. | ............ | A..A........ | 0.01 | 1 |
| ..... | ................. | T.AG.....NF......T | R...D. | .S.G.S.IA..G | A..A........ | 0.01 | 1 |
| ..... | F.....STA..Q.H.Q.L | ..........F......T | ...ND. | ...GTS..EF.Q | A..A........ | 0.01 | 1 |
| ....T | F................. | .V........F....... | ...... | ............ | A..A........ | 0.01 | 1 |
| .A... | ................. | ..ADH....DF....... | ...... | ENAGASDIA.DH | A..A........ | 0.01 | 1 |
| ..... | ................. | ..HG.....NF......T | ...DD. | ............ | ............ | 0.01 | 1 |
| GT... | F................. | .V........F....... | ...... | ............ | TERTG..FDE.D | 0.01 | 1 |
| .A... | F.....DR..SL.H.D.R | .Q.......DF....... | ...AD. | ............ | A..A........ | 0.01 | 1 |
| D.... | ......Q.......... | .Q.DH....NF....... | ...DD. | E.GGASD....S | A..A........ | 0.01 | 1 |
| RA... | ................. | .PPNG.....F......T | ...DDR | E.ADGA..AYDR | A..A........ | 0.01 | 1 |
| ..... | ................. | ................. | ...... | ............ | AARSG..SEG.D | 0.01 | 1 |
| TA... | ................. | .Q.DR.....F....... | ....D. | ............ | A..A........ | 0.01 | 1 |
| ..... | ................. | ................. | R...D. | EDGNAA.....R | A..A........ | 0.01 | 1 |
| RA... | F.....SG..IK.K.D.R | ..DGE....DF....... | ...... | EDARGADAE.GE | A..A........ | 0.01 | 1 |
| ..... | F................. | .V........F....... | ...... | ............ | GSSAG..AQV.Q | 0.01 | 1 |
| R.... | ................. | .V...........T | ...D.R | E.A.G..A...N | A..A........ | 0.01 | 1 |
| ..... | ................. | ................. | ...DDR | ............ | A..A........ | 0.01 | 1 |
| ..... | F................. | .V........F....... | ...... | ............ | ANKDH..YTT.D | 0.01 | 1 |
| SA... | F......T..PN.I...E | .Q.DR.....F....... | ....D. | ............ | A..A........ | 0.01 | 1 |
| .A... | F.....DAA.SA.K.A.R | TKHGG....NF....... | R..DDR | ............ | A..A........ | 0.01 | 1 |
| ..... | ................. | T.P......DF....... | ...DDR | ESGD.A..AVDE | A..A........ | 0.01 | 1 |
| ..... | ................. | TK.NE....DF......T | R..D.. | ...SAG....DR | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| GT... | .................. | .................. | R..AD. | .NGG.ND....Q | A..A........ | 0.01 | 1 |
| ..... | F................. | .V........F....... | ...... | .......... | DTRTA..IRT.. | 0.01 | 1 |
| GT... | ......DAA.IK.T.Q.N | ..DGE....DF....... | ...... | E.......... | .......... | 0.01 | 1 |
| H.... | F................. | .................. | ...DDR | .......... | .......... | 0.01 | 1 |
| ..... | .................. | .........F....... | ...... | ESAKT.DT.VDG | A..A........ | 0.01 | 1 |
| ..... | .................. | .........NF......T | E..AD. | ..ATESD..FDQ | A..A........ | 0.01 | 1 |
| ..... | .................. | TQPGG............. | G..NDR | .D.T.A.A...G | A..A........ | 0.01 | 1 |
| NT..T | F.....DTG.SK.T.T.R | .QPTG.....F....... | ...NGR | .......... | A..A........ | 0.01 | 1 |
| NA... | F................. | .................. | ...... | ENGD....E.DR | A..A........ | 0.01 | 1 |
| ..... | F................. | .................. | R...D. | ESA..S.AA..R | A..A........ | 0.01 | 1 |
| ..... | F................. | .V........F....... | ...... | .......... | EHRNT..SRE.E | 0.01 | 1 |
| GT... | F.....NT.....K.A.R | ..DGE....DF....... | ...... | .......... | .......... | 0.01 | 1 |
| TT..T | .................. | .................. | E..AD. | E.AKEN.A..DE | A..A........ | 0.01 | 1 |
| ..... | .................. | .................. | E..NG. | .......... | GPRAG..VE..D | 0.01 | 1 |
| RA... | F................. | TQ.TQ....DF....... | R...D. | E.AGTND.AV.H | A..A........ | 0.01 | 1 |
| ..... | .................. | TKHGG....NF......T | ...DDR | .S.G..D..FGG | .......... | 0.01 | 1 |
| HA... | .................. | .Q.S......F....... | E..N.. | .STSRGD...GG | A..A........ | 0.01 | 1 |
| ..... | .................. | .................T | ...ADR | .......... | A..A........ | 0.01 | 1 |
| ..... | .................. | .................. | ...ND. | ES.AA..AA..Q | A..A........ | 0.01 | 1 |
| ..... | F.....GRG.NV.N.S.R | ..YN......F......T | R...G. | .......... | A..A........ | 0.01 | 1 |
| ..... | F.....DTG.SK.T.T.R | .V........F....... | ...... | .NATEGDI..GG | A..A........ | 0.01 | 1 |
| GT... | .................. | .................. | R...D. | .NTAGND....R | A..A........ | 0.01 | 1 |
| AT... | .................. | .................. | ...N.. | ...G.N.A.... | A..A........ | 0.01 | 1 |
| D.... | F.....DRG.S..T.A.S | ..DGE....DF....... | ...... | .......... | A..A........ | 0.01 | 1 |
| RA... | .................. | ..DGE....DF....... | R...D. | .......... | .......... | 0.01 | 1 |
| ..... | .................. | .................. | ....G. | .DGGTA..EY.Q | A..A........ | 0.01 | 1 |
| GA... | F......N..NH.L.P.S | ..PNG....DF....... | ...DDR | E.AGGN..E.DD | A..A........ | 0.01 | 1 |
| TA... | .................. | TQ..H....NF....... | ...... | E.ANG...E.G. | A..A........ | 0.01 | 1 |
| DT... | F.....ASG.SV.I.S.R | ..DGE....DF....... | ...... | .......... | A..A........ | 0.01 | 1 |
| GT... | F.....AEG.LK.M.H.L | ..DT.....NF......T | ...DD. | .......... | A..A........ | 0.01 | 1 |
| DA... | F.....ATT.IM.T.T.R | .........NF....... | R...D. | EDAAR.D.A.D. | A..A........ | 0.01 | 1 |
| ..... | .................. | .................. | ...D.R | E..R.N.AEFGE | A..A........ | 0.01 | 1 |
| AA..T | F.....A.G..V.T.H.R | T.P......DF....... | ...D.. | .N.GA.D.A.GG | A..A........ | 0.01 | 1 |
| GA... | F.....DQ..R..P.S.R | .QPSQ....NF......T | ...N.. | .......... | A..A........ | 0.01 | 1 |
| .A..T | F.....NN..N..M...G | T.YNH.....F....... | ...D.. | .......... | A..A........ | 0.01 | 1 |
| ..... | F................. | .QPSQ....NF....... | ...DDR | .......... | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | .QAS.....DF....... | ...T.. | ........... | A..A........ | 0.01 | 1 |
| EA... | F.....DA..IA.L.K.R | ..DGE....DF....... | ...... | ESG.GN..EVDR | A..A........ | 0.01 | 1 |
| RA... | F.....DTG.SK.T.T.R | .Q.S......F....... | ...D.. | ........... | A..A........ | 0.01 | 1 |
| ..... | .................. | .................. | ...ADR | E........... | A..A........ | 0.01 | 1 |
| ..... | .................. | .................. | ...ND. | ESATGN..A.DN | A..A........ | 0.01 | 1 |
| TA... | F.....NRA.LA.....G | ..........F......T | ...ADR | ........... | A..A........ | 0.01 | 1 |
| ..... | .................. | .Q.S......F....... | ...... | EDAA.S..EV.R | A..A........ | 0.01 | 1 |
| E.... | F.....ASA.S..T.T.G | TQ.TH....DF....... | ....D. | E.AGAA..E.DR | A..A........ | 0.01 | 1 |
| TA... | .................. | E.HG.....NF......T | ...DDR | ........... | ........... | 0.01 | 1 |
| ..... | F................. | .V........F....... | ...... | ........... | A.KGS....R.E | 0.01 | 1 |
| RT... | F................. | .................. | ....D. | ........... | A..A........ | 0.01 | 1 |
| ..... | F.....SAG..L.H...K | TKDDR....DF....... | ...DDR | ........... | A..A........ | 0.01 | 1 |
| R.... | F.....SN...P.H.T.K | .........NF....... | R...D. | ........... | A..A........ | 0.01 | 1 |
| ..... | .................. | .................. | ...DD. | EDGNGSDT..DS | A..A........ | 0.01 | 1 |
| .T... | F.....GS..NM.N.T.R | ..DGE....DF....... | ...... | E...GA.AA..E | A..A........ | 0.01 | 1 |
| N.... | F.....AR..L..P.D.K | .QPN......F......T | ...N.. | EDGKGA....GE | A..A........ | 0.01 | 1 |
| GT... | F.....AEG.LK.M.H.L | .................. | ...... | ........... | ........... | 0.01 | 1 |
| GT... | F.....GQI.LN.L.D.R | .QPG.....NF....... | ...DDR | .DASGDD.EVD. | A..A........ | 0.01 | 1 |
| AA... | .................. | T.PNE....DF....... | R...D. | ..ATRS.I..GN | A..A........ | 0.01 | 1 |
| ..... | F................. | .V........F....... | ...... | ........... | GPHS...FQS.D | 0.01 | 1 |
| D...T | F.....SN..PL.K.T.. | ..HG.....NF......T | R..ADR | ........... | A..A........ | 0.01 | 1 |
| RT... | .................. | .QHNQ.....F......T | ...N.. | ........... | A..A........ | 0.01 | 1 |
| ..... | .................. | F................. | ...DDR | EDGNTN.A.VDS | A..A........ | 0.01 | 1 |
| AA... | F.....NAT.RD.M.T.K | .QPN......F......T | ...N.. | ........... | A..A........ | 0.01 | 1 |
| .A... | .................. | F................. | ...AG. | ........... | A..A........ | 0.01 | 1 |
| DA... | .................. | .........DF......T | R..D.. | ........... | A..A........ | 0.01 | 1 |
| ..... | F.....AKG.P..H.P.R | .QANH.....F......T | ...D.. | ........... | A..A........ | 0.01 | 1 |
| TA... | .................. | ..........F....... | ...... | E........... | A..A........ | 0.01 | 1 |
| ..... | F.....GG..NK.M.... | F................. | ....GR | ........... | A..A........ | 0.01 | 1 |
| E.... | F.....SHG.II.K.G.R | ..HG.....NF......T | R...D. | ESAK..D.E..N | A..A........ | 0.01 | 1 |
| A.... | F.....G.G.HA.T.G.R | ..HDG.....F....... | R...D. | E.GAGAD...GQ | A..A........ | 0.01 | 1 |
| ..... | F................. | F................. | R..DD. | .D.GAG.T...G | A..A........ | 0.01 | 1 |
| ..... | F................. | F................. | ...... | E.TSTS.A.VGE | A..A........ | 0.01 | 1 |
| G...T | F.....SGT.SQ.K.E.. | .KYT.....NF......T | ...DDR | ........... | A..A........ | 0.01 | 1 |
| G.... | F................. | .Q.S......F....... | E..N.. | ........... | ........... | 0.01 | 1 |
| ..... | F................. | .QPG.....DF....... | E..AG. | .SGGA.D.E..N | A..A........ | 0.01 | 1 |

TABLE 3-continued

AAV capsid proteins having increased specificity for and/or transduction of CD447$^-$/133$^-$ GBM cells (pool of Round 1 selection). Amino acid numbers correspond to the amino acid sequence of VP1 (SEQ ID NO: 1). Sequences below correspond to SEQ ID NOs: 8 and 524-3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| AA... | ................. | ..YN......F......T | ....G. | ...G.S..AFGD | A..A........ | 0.01 | 1 |
| A.... | F.....NKT.HL.T.A.R | TQASG.....F....... | R...D. | E.ATA...E.DD | A..A........ | 0.01 | 1 |
| ..... | ................. | ................. | G..N.. | ............ | ............ | 0.01 | 1 |
| ..... | ................. | ..PNG....DF....... | E..N.. | E..RRA.....Y | A..A........ | 0.01 | 1 |
| ..... | ................. | ..........DF...... | ...D.. | .DTS.A.AA.GE | A..A........ | 0.01 | 1 |
| ..... | F.....SGT.NM.K.T.E | ................. | ...... | ............ | A..A........ | 0.01 | 1 |
| ..... | F................ | .V......F....... | ...... | ............ | DRSDP..Y.A.Q | 0.01 | 1 |
| RT... | F......GG.NV...G.M | .Q.GQ....DF....... | ....G. | ............ | A..A........ | 0.01 | 1 |
| TA... | ................. | .KYT.....NF....... | R...D. | ED.GGND.EV.D | A..A........ | 0.01 | 1 |
| ET..T | F.....NGG.NN.K.T.R | ................. | ...... | ............ | A..A........ | 0.01 | 1 |
| ..... | ................. | ................. | R..DG. | ..GG...I..GH | A..A........ | 0.01 | 1 |
| ..... | ................. | .........NF......T | ...... | .SGKTADAEVGD | A..A........ | 0.01 | 1 |
| NA... | F.....DA..IA.L.K.R | ................. | ...... | .NTGTA..E... | A..A........ | 0.01 | 1 |
| AA... | F.....D.G.LK.T.N.V | .........NF....... | R...D. | ENAKG..AEF.D | A..A........ | 0.01 | 1 |
| ..... | ................. | ................. | ....GR | ..AG.N.AA.GQ | A..A........ | 0.01 | 1 |
| NA... | F.....GGT.PM.K.D.R | .QPSQ....NF....... | E..TD. | ENTSEG.....R | A..A........ | 0.01 | 1 |
| G.... | F.....SNG.RE.L...K | TKDDR....DF....... | ...DDR | ............ | A..A........ | 0.01 | 1 |
| A...T | F.....GAG.HV.M...R | ................. | ...... | ............ | A..A........ | 0.01 | 1 |
| ..... | F.....GS..NK.M.A.R | ..ADH....DF....... | ...... | E.AGAND.AV.H | A..A........ | 0.01 | 1 |
| ..... | F......QG.NQ...A.R | .Q.S......F....... | ...D.. | ............ | A..A........ | 0.01 | 1 |
| EA..T | F.....NG..IQ.M.N.R | ..DGG.....F...P...T | R..D.R | ............ | A..A........ | 0.01 | 1 |
| ..... | ................. | .........NF....... | R...D. | ..TGTS...YGS | A..A........ | 0.01 | 1 |
| TA... | F.....AGA.NK.L...K | .QPTG....NF....... | ...D.R | E.ANGG.A...D | A..A........ | 0.01 | 1 |
| GA..T | ......NGT..V.P.E.G | T..G.....NF......T | ....G. | ............ | A..A........ | 0.01 | 1 |
| R...T | ................. | .QPN......F......T | ...N.. | ............ | A..A........ | 0.01 | 1 |
| .A... | F................ | ................. | ....D. | ............ | A..A.......H | 0.01 | 1 |
| ..... | F................ | .V........F....... | ...... | .......G... | SPRDA..N.G.D | 0.01 | 1 |
| TT... | F.....ASA.S..T.T.G | .QPG.....DF....... | ...DDR | .D.GRA..E.GE | A..A........ | 0.01 | 1 |
| ..... | ................. | ................. | R..DG. | ............ | A..A........ | 0.01 | 1 |
| GT... | F.....S.G.RQ.T.E.R | .Q.DR....DF....... | R..A.. | .N.SRA.AE..E | A..A........ | 0.01 | 1 |
| ..... | ................. | ................. | R..D.. | .SAS.N.IA..E | A..A........ | 0.01 | 1 |
| ..... | ................. | ..........DF......T | E..TGR | ESGTAA.AA..E | A..A........ | 0.01 | 1 |
| SA..T | ................. | ..DGE....DF....... | R...D. | ............ | A..A........ | 0.01 | 1 |
| DA..T | F.....NR..N..I.T.G | TQ.TQ.....F....... | ...DDR | E.ADRN....GS | A..A........ | 0.01 | 1 |
| ..... | ................. | ................. | E..N.. | E..D.N...Y.S | A..A........ | 0.01 | 1 |
| ..... | F.....GS..NM.N.T.R | T.PGG....NF....... | ...DD. | ............ | A..A........ | 0.01 | 1 |

TABLE 3-continued

AAV capsid proteins having increased specificity for and/or transduction of CD447⁻/133⁻ GBM cells
(pool of Round 1 selection). Amino acid numbers correspond to the amino acid sequence
of VP1 (SEQ ID NO: 1). Sequences below correspond to SEQ ID NOs: 8 and
524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| HA... | F.....SN..PLKK.T.. | .QPN......F......T | ...N.. | E.AGAA..E.DR | A..A........ | 0.01 | 1 |
| ..... | ................ | ................ | ...DDR | ..ANRD.A..DQ | A..A........ | 0.01 | 1 |
| ..... | F................ | .V.......F....... | ...... | .DAAGA.IE.GN | A..A........ | 0.01 | 1 |
| ....T | F................ | .........DF...... | ...NDR | ..TTGA..AY.D | A..A........ | 0.01 | 1 |
| ..... | ................ | .....D........... | ...DDR | ............ | ............ | 0.01 | 1 |
| R.... | ................ | TKDDR....DF...... | ...DDR | E.AAGND.EFDQ | A..A........ | 0.01 | 1 |
| RT... | F.....D.T.HP.M...R | .QPTR....DF...... | ...D.. | ESGTGND.E.DG | A..A........ | 0.01 | 1 |
| ..... | ................ | T.P......DF...... | ...DDR | .NASG..A.VGQ | A..A........ | 0.01 | 1 |
| G...T | F.....GGG.NQ.I.S.G | TQ.TG....DF...... | ...DDR | ESAG.DD.A.DQ | A..A........ | 0.01 | 1 |
| GA... | F.....GRG.SE.N.P.H | .V........F...... | ...... | EDAG...I..GQ | A..A........ | 0.01 | 1 |
| TT... | ................ | ................ | ...... | E.AAGND.EFDQ | A..A........ | 0.01 | 1 |
| ..... | F................ | .........DF...... | ....GR | ESGTAND...DR | A..A........ | 0.01 | 1 |
| NT... | F......AT.SN.I.Q.R | TKAT.....NF......T | ...... | E.ATA.DAA.DQ | A..A........ | 0.01 | 1 |
| ..... | ................ | .KYT.....DF...... | ...AD. | .SAA.S.TEVDS | A..A........ | 0.01 | 1 |
| RA... | F.....DGA.R..P.A.K | .QPNQ....DF...... | ...... | ............ | A..A........ | 0.01 | 1 |
| ..... | F................ | .V.......F....... | ...... | ............ | DTRSG..SNA.P | 0.01 | 1 |
| AT... | F................ | .V.......F....... | ...... | ............ | DPRTR..ATE.A | 0.01 | 1 |
| D...T | F.....NAT.IM.T.H.R | T.P......DF...... | ...D.R | ............ | ............ | 0.01 | 1 |
| ..... | ................ | .QDT......F......T | R..KD. | ............ | A..A........ | 0.01 | 1 |
| ..... | F......G..NQ.N.D.K | .QHNQ.....F......T | E..KD. | ..TG.A...VGN | A..A........ | 0.01 | 1 |
| ..... | ................ | ................ | ....D. | E.GGGA.AEVGD | A..A........ | 0.01 | 1 |
| ..... | F................ | .V.......F....... | ...... | ............ | GRDN....RV.E | 0.01 | 1 |
| SA... | F.....SG..IK.K.D.R | T.A.Q....DF...... | G..A.R | ............ | A..A........ | 0.01 | 1 |
| ..... | ................ | ................ | E..ND. | .DGKGND...DG | A..A........ | 0.01 | 1 |
| ..... | ................ | ................ | R...D. | ..AKG...AV.. | A..A........ | 0.01 | 1 |
| ..... | F.....ATA..V.H...R | .QAS......F...... | ...... | .SGDE.D.E.DR | A..A........ | 0.01 | 1 |
| ..... | ................ | ................ | ...DDR | ENASG.....GN | A..A........ | 0.01 | 1 |
| R.... | ................ | ................ | G..K.. | ............ | A..A........ | 0.01 | 1 |
| E.... | F......TG.IL...T.R | .QAS.....NF......T | ....GR | ............ | ............ | 0.01 | 1 |
| GT... | F.....AEG.LK.M.H.L | ..DGE....DF...... | R...D. | ..........G. | ............ | 0.01 | 1 |
| ..... | ................ | ................ | ...TD. | ............ | A..A........ | 0.01 | 1 |
| ..... | F.....SA..RA.....R | ................ | ...... | ............ | A..A........ | 0.01 | 1 |
| ..... | ................ | ................ | G..ND. | ............ | ............ | 0.01 | 1 |
| ..... | ................ | .QPN......F......T | ...N.. | ESGD.A.AA.GE | A..A........ | 0.01 | 1 |
| ..... | F................ | .V.......F....... | E..ND. | ............ | A..A........ | 0.01 | 1 |
| ..... | ......KT.NV.K.T.H | .Q.......DF...... | G..TG. | ............ | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| AA... | ................. | T.AG......F......T | ...DD. | ..TKRDD.A.DE | A..A........ | 0.01 | 1 |
| SA... | F......GA.HP.K...V | .V........F....... | R...G. | E..AAS....GG | A..A........ | 0.01 | 1 |
| G.... | F.....GS..NK.M.A.R | ..YN......F......T | R..N.. | ENGGAAD.A..N | A..A........ | 0.01 | 1 |
| ET..T | F................. | .V........F....... | R..DG. | E..GASD.A..Q | ............ | 0.01 | 1 |
| N.... | F.....GTT.IL.M...K | ..DGE....DF...... | E..NGR | ............ | A..A........ | 0.01 | : |
| G.... | F................. | .V........F....... | ...... | ............ | KDRAA..VHN.H | 0.01 | : |
| D.... | F.....GKG.ND.T.N.G | T.AG.....NF......T | ...D.R | ............ | A..A........ | 0.01 | 1 |
| ..... | F.....SN..PL.K.T.. | ..HG.....NF......T | R..ADR | ............ | A..A........ | 0.01 | 1 |
| E.... | F.....AQG.SN.K.G.K | ................. | G..ND. | ............ | A..A........ | 0.01 | 1 |
| AT... | ................. | ..HG.....NF......T | R..DG. | ............ | A..A........ | 0.01 | 1 |
| DA... | F.....AHG.PP.L.N.K | .K.TG.....F......T | ...DDR | ............ | A..A........ | 0.01 | : |
| ..... | ................. | .QPN......F......T | ...N.. | .DGRAG..E.GE | A..A........ | 0.01 | 1 |
| AT... | ................. | .QHNQ.....F....... | ...... | ............ | A..A........ | 0.01 | 1 |
| A.... | ................. | ................. | R..DD. | ............ | ............ | 0.01 | 1 |
| ..... | ................. | ........NF......T | ...DDR | ED.R.S.A...G | A..A........ | 0.01 | 1 |
| G.... | F.....A...ND.T...K | TQ.TG....DF....... | ...DDR | E.AAGSDI...H | A..A........ | 0.01 | 1 |
| TT..T | ................. | ..DGE....DF...... | ....D. | ............ | ............ | 0.01 | 1 |
| A.... | F.....SRG.IE.K...L | .KYT.....NF......T | ...DDR | ............ | A..A........ | 0.01 | 1 |
| ..... | F.....DGT..V.H.H.V | .V........F....... | ...... | ............ | ............ | 0.01 | 1 |
| .A... | ................. | ..HG.....NF...... | F...KD | ............ | A..A........ | 0.01 | 1 |
| ..... | F................. | ..HG.....NF......T | ...A.. | ............ | A..A........ | 0.01 | 1 |
| H.... | F.....DRG.S..T.A.S | ..DGE....DF...... | ...... | ............ | ............ | 0.01 | 1 |
| TA... | F................. | ................. | ....GR | ...RGND..V.E | A..A........ | 0.01 | 1 |
| ..... | ................. | ................. | R..DD. | ESGGAD.I...R | A..A........ | 0.01 | 1 |
| ..... | ................. | ................. | ...D.. | ....GS.IA..N | A..A........ | 0.01 | 1 |
| ..... | ................. | ................. | G..TDR | E.AGGN..E..S | A..A........ | 0.01 | 1 |
| NT..T | ................. | T.P......DF...... | ...D.R | EDANGGDAE.GH | A..A........ | 0.01 | 1 |
| AA... | ................. | ................. | G..NDR | ...G.S..AFGD | A..A........ | 0.01 | : |
| R.... | ................. | TQ.TG....DF...... | ...DDR | E..KAS..AVDH | A..A........ | 0.01 | 1 |
| ..... | ......DRG.S..T.A.R | ..A......DF...... | ...DG. | ............ | ............ | 0.01 | 1 |
| NT..T | ................. | ..DGE....DF...... | R...D. | ..GNAD.AAV.D | A..A........ | 0.01 | 1 |
| ..... | F................. | .V........F....... | ...... | ............ | SARNT..YNN.T | 0.01 | 1 |
| H.... | F................. | .V........F......E | ...... | ............ | D.KG...VDR.E | 0.01 | 1 |
| .A... | F.....NQG..V.L.N.R | T.P......DF...... | ...D.. | E.AKTADA..GH | A..A........ | 0.01 | 1 |
| ..... | F................. | .V........F....... | ...... | ............ | S.RNP..NEV.H | 0.01 | 1 |
| RA... | ................. | ................T | ...D.. | ............ | ............ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| RA... | ................. | .QHNQ.....F......T | R..D.. | .DTG.N..A..R | EKKTH..ADS.A | 0.01 | 1 |
| NA..T | ................. | .Q.DR.....F....... | ....D. | E.AT.S.AAF.E | A..A........ | 0.01 | 1 |
| G.... | ................. | ................. | ...DDR | ..AG..D..YGE | ............ | 0.01 | 1 |
| .A... | ......NN..SA.N...R | ................. | E..AD. | ............ | A..A........ | 0.01 | 1 |
| GA... | F.....SGT.S..T.T.. | ..AGR....DF......T | R..D.. | ............ | A..A........ | 0.01 | 1 |
| ..... | ................. | ................. | ...N.. | .STSRGD...GG | A..A........ | 0.01 | 1 |
| ..... | ................. | ................. | ....GR | .NGGGA.I.FDG | A..A........ | 0.01 | 1 |
| ..... | F................ | .V........F....... | ...... | ............ | GPRTA...SG.H | 0.01 | 1 |
| NT..T | ......AST.IN.L.T.. | ..DGE....DF....... | ...... | ............ | ............ | 0.01 | 1 |
| D.... | F.....AN...N.L.H.R | .V........F....... | ...... | .SGGRS..E.DQ | A..A........ | 0.01 | 1 |
| DA... | F.....SGG.RV.P...G | T.AG.....DF....... | ...D.. | ............ | A..A........ | 0.01 | 1 |
| A...T | ................. | ................. | E..ND. | .DAS.N...VDG | A..A........ | 0.01 | 1 |
| GA... | ................. | ................. | ....D. | ..GGGA.AEVGD | A..A........ | 0.01 | 1 |
| DT... | ................. | ...............F. | ...... | ..AA.N..AFGE | A..A........ | 0.01 | 1 |
| TA..T | F.....SKT.NE.P...M | .QHNQ....NF......T | ....GR | .NAGA.D.AFDE | A..A........ | 0.01 | : |
| ..... | F.....G.G.HA.T.G.R | ..HDG.....F....... | R...D. | E.GAGAD...GQ | A..A........ | 0.01 | 1 |
| RA... | ................. | .Q.GQ....DF....... | ....G. | E..TEG...VDS | A..A........ | 0.01 | 1 |
| T...T | F.....NGG.NV.N.K.G | T.ASH....DF....... | ...D.. | ..ARRS.A.FDD | A..A........ | 0.01 | 1 |
| ..... | F................ | .V........F....... | ...... | ............ | GQRNG...ST.T | 0.01 | 1 |
| G.... | F.....SAT.PV.T.Q.G | ...TE.....F......T | ...D.. | ............ | A..A........ | 0.01 | 1 |
| ..... | ................. | .Q.......DF....... | E..AD. | ............ | A..A........ | 0.01 | : |
| EA... | F.....SSA..V.H.H.. | ................. | ...... | ............ | ............ | 0.01 | 1 |
| ..... | ................. | ................. | ...... | ENGRGG.AEV.D | A..A........ | 0.01 | 1 |
| AT... | F.....S.G.RQ.T.E.R | .Q.......DF....... | ...AD. | ............ | A..A........ | 0.01 | i |
| SA... | F.....NGT.IL.T.A.K | .Q.S......F....... | R...D. | .SANESD...DQ | A..A........ | 0.01 | : |
| ..... | F................ | ................. | ...ADR | ............ | A..A........ | 0.01 | 1 |
| ..... | ................. | ...........F..... | R..AGR | .NA.RA.T..G. | A..A........ | 0.01 | 1 |
| NT... | ................. | ................. | R..DD. | E..G.S.T.FDS | A..A........ | 0.01 | 1 |
| ..... | F................ | .V........F....... | ...... | ............ | GPKDR..AQE.P | 0.01 | 1 |
| TT... | F.....SGT.NM.K.T.E | .........NF....... | R...D. | ............ | A..A........ | 0.01 | 1 |
| SA... | F.....GHG.NK.I.N.R | .QPG.....DF....... | ...DDR | ............ | ............ | 0.01 | 1 |
| ..... | F................ | .V........F....... | ...... | ............ | S.RSG..F.I.Q | 0.01 | 1 |
| ..... | ................. | T.PSH....DF......T | ...DDR | ............ | A..A........ | 0.01 | 1 |
| T.... | F.....GS..NK.M.A.R | .QPSR.....F....... | ...... | ............ | A..A........ | 0.01 | 1 |
| ..... | ................. | ................. | G..NDR | .NA.AS.A..DR | A..A........ | 0.01 | 1 |
| ..... | ................. | ................. | ...N.. | ...TG.D.AY.G | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F.....AGA.SL.....R | .QDGG....F.......T | R..DD. | ENAGASDIA.DH | A..A........ | 0.01 | 1 |
| ..... | .................. | .................. | ...D.R | .D.D...AEFGD | A..A........ | 0.01 | 1 |
| TT... | .................. | .................. | ...... | ............ | ............ | 0.01 | 1 |
| G.... | .................. | ..HG.....NF......T | E..DD. | ............ | ............ | 0.01 | 1 |
| TT..T | .................. | .PPN......F....... | R...D. | ............ | A..A........ | 0.01 | 1 |
| ..... | .................. | .................. | ...D.. | .D.TGN.I...Q | A..A........ | 0.01 | 1 |
| ..... | F......NA.IA.K.H.G | .........NF....... | R...D. | E.AA.NDA..DD | A..A........ | 0.01 | 1 |
| AA... | F.....SAT.NL.P.N.L | .................. | ...... | .NARGNDAEF.E | A..A........ | 0.01 | 1 |
| ..... | F................. | .V........F....... | ...... | ............ | DQKAT..SQM.A | 0.01 | 1 |
| ..... | .................. | .................. | ....D. | E.TS.D..AFDQ | A..A........ | 0.01 | 1 |
| ..... | .................. | .................. | G..TDR | ............ | A..A........ | 0.01 | 1 |
| RT... | F.....DR..LE.K...R | ....A............. | ...... | ............ | A..A........ | 0.01 | 1 |
| ..... | .................. | T.HTE....NF......T | G..K.R | ...ARAD.AY.G | A..A........ | 0.01 | 1 |
| SA... | .................. | .................. | ...... | ............ | ............ | 0.01 | 1 |
| .A... | F.....DRG.S..T.A.S | ..DGE....DF....... | R...D. | ............ | ............ | 0.01 | 1 |
| E.... | .................. | .................. | R...D. | E.AKGSD.AY.G | A..A........ | 0.01 | 1 |
| .A... | F.....ATG.S..P.... | TKHDR....DF....... | ...... | ............ | A..A........ | 0.01 | 1 |
| G...T | .................. | .................. | R..DD. | ............ | A..A........ | 0.01 | 1 |
| A.... | F.....DRA..K.I.K.H | .QAS......F....... | R..... | .SGGESDAA..E | A..A........ | 0.01 | 1 |
| DT..T | F.....GS..NM.N.T.R | .................. | ...... | ............ | A..A........ | 0.01 | 1 |
| ..... | F................. | .V........F....... | ...... | ............ | ARQGT..SS... | 0.01 | 1 |
| ..... | .................. | .KDSR....DF....... | ...DDR | E..GGD.A...G | A..A........ | 0.01 | 1 |
| A...T | F......KT.NV.K.T.H | .................. | ...... | ............ | A..A........ | 0.01 | 1 |
| RA... | .................. | TQ.TG....DF....... | ...DDR | E..RRD.AA..H | A..A........ | 0.01 | 1 |
| ..... | .................. | .................. | R...D. | .SARG.D.AVDD | A..A........ | 0.01 | 1 |
| ..... | F.....SGG.NL.L.N.L | T.P......DF....... | ...D.. | ............ | A..A........ | 0.01 | 1 |
| RA... | .................. | .................. | R..DD. | EN.KAN....GG | A..A........ | 0.01 | 1 |
| ..... | .................. | .PPNG.....F......T | ...DDR | .DAG.S.A..DR | A..A........ | 0.01 | 1 |
| ..... | F................. | .V........F....... | ...... | ............ | AARAG...SA.. | 0.01 | 1 |
| ..... | .................. | .........NF..P.... | G..K.. | ............ | A..A........ | 0.01 | 1 |
| AA..T | F.....SQ..RA...D.S | ..DGE....DF....... | ...... | E.AKES....GQ | A..A........ | 0.01 | 1 |
| SA... | .................. | TQPNH....NF......T | ...... | ...TAND.A.DG | A..A........ | 0.01 | 1 |
| ..... | F................. | .................. | ....D. | ...ARS.A.FDG | A..A........ | 0.01 | 1 |
| AT..T | .................. | .................. | ...NGR | ............ | A..A........ | 0.01 | 1 |
| ..... | .................. | TQ.TG....DF....... | ...AD. | .NAGASDA.FDQ | A..A........ | 0.01 | 1 |
| ..... | .................. | ..HGH....NF......T | ...D.R | ............ | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524..3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | .................. | ...D.. | E.AGAN.A...S | A..A........ | 0.01 | 1 |
| DT... | ................. | .V........F....... | ...... | ............ | SRKAP..FE..A | 0.01 | 1 |
| GA... | ................. | .QDT......F......T | R..KD. | ............ | A..A........ | 0.01 | 1 |
| ..... | ................. | TKAT.....NF......T | ...D.. | .DAGAN.AEVDH | A..A........ | 0.01 | 1 |
| TT..T | ................. | .Q.G......F..P.... | ...... | ES.GEG...VDS | A..A........ | 0.01 | 1 |
| TA... | .....NQG..V.L.N.R | .V........F....... | ....DR | ............ | ............ | 0.01 | 1 |
| ..... | ................. | ...TE.....F......T | ...NGR | ............ | A..A........ | 0.01 | 1 |
| R.... | ................. | TKDDR....DF....... | ...DDR | .NARASDAAVDQ | A..A........ | 0.01 | 1 |
| ..... | ................. | .QANH....DF....... | ...DDR | ............ | A..A........ | 0.01 | 1 |
| TA..T | F.....ARA.IE.....L | .Q.DR.....F....... | ....DE | .NGGGN..E.DG | A..A........ | 0.01 | 1 |
| ..... | F................. | .V........F....... | ...... | ............ | D.SDP..STK.E | 0.01 | 1 |
| ET..T | ................. | TQASG.....F....... | ...... | .SGGGD..E.DD | A..A........ | 0.01 | 1 |
| ..... | F.....AA..IQ.T.K.R | .................. | ...... | ............ | A..A........ | 0.01 | 1 |
| ..... | F................. | .............F..... | E..AD. | ............ | GAHDN..FET.Q | 0.01 | 1 |
| AT... | ................. | .QPG.....DF....... | ...DDR | ............ | ............ | 0.01 | 1 |
| ..... | F................. | .V........F....... | ...... | ............ | NPRAR..DDV.Q | 0.01 | 1 |
| ..... | ................. | ........DF....... | G..KD. | ENASG.....GN | A..A........ | 0.01 | 1 |
| A.... | ................. | .V........F....... | ...... | ............ | T.HTR..DDV.A | 0.01 | 1 |
| ..... | F................. | .V........F....... | ...... | ............ | GPRAP..VRT.D | 0.01 | 1 |
| ..... | F.....SA..SM.M.T.K | TKDT.....NF....... | R...D. | ............ | A..A........ | 0.01 | 1 |
| ..... | ................. | .................. | ...... | E.GSGS.AVD. | A..A........ | 0.01 | 1 |
| R.... | F................. | ..DGE....DF....... | E..AD. | ............ | A..A........ | 0.01 | 1 |
| AA... | ................. | .................. | R.AD. | ............ | A..A........ | 0.01 | 1 |
| D...T | ................. | .................. | ...DD. | ESAA.D.E.GN | A..A........ | 0.01 | 1 |
| .A... | F....ASA.S...T.A.S | ..DGE....DF....... | ...... | ............ | ............ | 0.01 | 1 |
| ..... | F.....ADA..H.K.S.. | .Q.S......F....... | ...... | ............ | A..A........ | 0.01 | 1 |
| GA... | F.....S.A.M..L...L | .V........F....... | R...D. | E.AAGSD..... | S.SNG...GG.T | 0.01 | 1 |
| RA... | F....A.A.RE.I.... | .QDT.............. | R..DD. | ............ | ............ | 0.01 | 1 |
| TA... | F.....AGG.SH.M.N.K | .Q.S......F....... | R..NG. | EDAG..I..GQ | A..A........ | 0.01 | 1 |
| DT... | ................. | .PDNR..T.DF......T | ....GR | ............ | A..A........ | 0.01 | 1 |
| .A... | F................. | .................. | R..DG. | ..GG..I..GH | A..A........ | 0.01 | 1 |
| ..... | F................. | .V........F....... | ...... | ............ | AKHTA..SEG.T | 0.01 | 1 |
| R.... | ................. | ..HG.....NF......T | E....R | ..A.AN..AF.D | A..A........ | 0.01 | 1 |
| RT... | F.....GNG.HV.H.G.R | T.P......DF.L..... | ...D.. | ............ | A..A........ | 0.01 | 1 |
| ..... | F.....SAG.SK.H.Q.S | .Q.S......F....... | R..A. | ............ | A..A........ | 0.01 | 1 |
| TT... | F.....SRT..Q.H.Q.L | .QPTG....NF....... | ...... | .NAA.A....GD | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| DT... | ................. | .V........F....... | ...... | ........... | ............ | 0.01 | 1 |
| ..... | ................. | ................. | ...D.. | .DAT....A.DG | A..A........ | 0.01 | 1 |
| SA... | F.....NRT.LL.T.G.R | ..YN......F......T | ...D.R | ........... | A..A........ | 0.01 | 1 |
| EA... | F.....SR..PN.M.K.I | .V........F....... | ...... | ........... | GQHD...V.N.E | 0.01 | 1 |
| A.... | F.....DR..LE.K...R | ....A............. | ...... | ........... | A..A........ | 0.01 | 1 |
| ..... | ................. | E.........F..P...T | R.A.R | ........... | A..A........ | 0.01 | 1 |
| SA... | ................. | ................. | ...... | ........... | A..A........ | 0.01 | 1 |
| ..... | ................. | ................. | E..AG. | ........... | A..A........ | 0.01 | 1 |
| .A... | F.....AKG.NM.L...K | ..DGE....DF....... | ...... | ESGGTD...DH | A..A........ | 0.01 | 1 |
| D...T | ................. | .Q.......DF....... | G..ND. | E.TATAI.VGS | A..A........ | 0.01 | 1 |
| AT... | ................. | .Q.G.....NF....... | ...DDR | ........... | A..A........ | 0.01 | 1 |
| ..... | ................. | ................T | R...D. | ........... | ............ | 0.01 | 1 |
| ..... | ................. | .PPNG.....F......T | ...DDR | E.TR.N.....Q | A..A........ | 0.01 | 1 |
| ..... | ................. | ................. | ...D.. | ENAGAA..EFGQ | A..A........ | 0.01 | 1 |
| D...T | F......GT.NM.L.Q.S | .Q.S.....DF....... | ...... | ........... | ............ | 0.01 | 1 |
| TA... | F.....NGG.LM.I.G.R | ................. | ...DDR | E.GSGS..AVD. | A..A........ | 0.01 | 1 |
| ..... | ................. | ................. | ...... | ..ANTNTA.DS | A..A........ | 0.01 | 1 |
| ..... | F.....NGG.NV.N.K.G | .........NF....... | R...D. | ........... | A..A........ | 0.01 | 1 |
| SA... | F.....STA..Q.H.Q.L | ..PNG....DF....... | G..NDR | ........... | A..A........ | 0.01 | 1 |
| R...T | F.....AAA.NI.L.K.N | ..PNG....DF....... | G..NDR | ........... | A..A........ | 0.01 | 1 |
| ..... | ................. | .........NF......T | ...K.. | .NAKGA.....H | A..A........ | 0.01 | 1 |
| ..... | ................. | ................. | ....D. | EDASG....FDR | A..A........ | 0.01 | 1 |
| ..... | ................. | ................. | ...DG. | .SAS.N.I..GD | A..A........ | 0.01 | 1 |
| S.... | ................. | ..YN......F......T | ...D.R | E.TGRA..A..R | A..A........ | 0.01 | 1 |
| ..... | ................. | ................. | ...... | ...TG..T..GQ | A..A........ | 0.01 | 1 |
| ..... | ................. | .QPSQ....NF....... | R..DD. | ........... | ............ | 0.01 | 1 |
| ..... | ................. | ................. | G..ND. | .DADAA..AVD. | A..A........ | 0.01 | 1 |
| E.... | F.....ASA.S..T.T.G | ................. | R..ND. | ..AG.N.AA.GQ | ............ | 0.01 | 1 |
| A.... | ................. | ................. | R..ADR | EN.D...A..GD | A..A........ | 0.01 | 1 |
| T.... | F.....NKT.IV.T.E.R | ..HG.....NF......T | ...DD. | ........... | A..A........ | 0.01 | 1 |
| ..... | F.....GK..LA.K.N.G | .Q.S......F....... | E..N.. | ........... | A..A........ | 0.01 | 1 |
| ..... | ................. | ................. | ....GR | E.AGRDD...DR | A..A........ | 0.01 | 1 |
| ..... | F................ | .V........F....... | ...... | ........... | GKSNP..SQA.P | 0.01 | 1 |
| ..... | ................. | ................. | ....G. | ........... | ............ | 0.01 | 1 |
| ..... | ................. | ................. | E..AD. | ..TAAD...VGG | A..A........ | 0.01 | 1 |
| GT... | F.....AEG.P..L...G | .V........F....... | ...... | EN.GE..IA.DR | ............ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| NAT.. | ................. | ................. | E..KD. | ........... | ........... | 0.01 | 1 |
| ..... | ................. | ................. | ...DDR | ........... | ARHNA..DSM.A | 0.01 | 1 |
| G.... | ......DKG.HM.L.G.R | .Q.......DF...... | ...AD. | .SADGSD...DR | A..A....... | 0.01 | 1 |
| D...T | F.....DSG.NM.H.A.R | .........NF...... | R...D. | ........... | A..A....... | 0.01 | 1 |
| A.... | ................. | ................. | ...DDR | ..AS.N.IA.GD | A..A....... | 0.01 | 1 |
| .A... | ................. | ..PN.....NF...... | ...NDR | E.GA.N..A..H | A..A....... | 0.01 | 1 |
| TA... | F.....AG.....N.E.R | .QPN......F......T | ...N.. | ........... | A..A....... | 0.01 | 1 |
| ..... | F.....NKT.HL.T.A.R | ..YN......F......T | ...D.R | ........... | A..A....... | 0.01 | 1 |
| .A... | ................. | .QAS......F...... | ...... | E..NTA.A..GE | A..A....... | 0.01 | 1 |
| TA... | ......A.......... | ................. | ...... | ..GGGN.IE..R | ........... | 0.01 | 1 |
| E.... | F.....GAT.IN.M.K.L | T.ANE....DF...... | ...DDR | ........... | ........... | 0.01 | . |
| ..... | ................. | ..........F...... | ....G. | E.GNGS....GR | A..A....... | 0.01 | 1 |
| RA... | F.....DGG.NL.....N | TKDDR....DF...... | ...DDR | ........... | A..A....... | 0.01 | 1 |
| E.... | F................. | ................. | ...DG. | E.TT.A...VGD | A..A....... | 0.01 | 1 |
| SA..T | F.....SA..SM.M.T.K | TKDT.....NF...... | R...D. | ........... | A..A....... | 0.01 | 1 |
| AA... | F.....SN..PL.K.T.. | ................. | R..ND. | ED.GR....F.R | A..A....... | 0.01 | 1 |
| A.... | F.....AET..A.T...K | .QPTG....NF...... | E..AGR | ESAGRS...VDR | A..A....... | 0.01 | 1 |
| ..... | F................. | ................. | R..DDR | E.AGES.A.Y.Q | A..A....... | 0.01 | 1 |
| .T... | F................. | .V........F...... | ...... | ........... | GRKGG..DRE.. | 0.01 | 1 |
| EA... | F.....GSA.RV.L.A.R | .Q.DR.....F...... | ....GR | ED.G.SD..FDE | A..A....... | 0.01 | 1 |
| ..... | ................. | .........NF...... | ...D.. | .NGNTGD....N | A..A....... | 0.01 | 1 |
| RA... | ................. | ................. | ...NDR | ..AKG...AV.. | A..A....... | 0.01 | 1 |
| ..... | ................. | ................. | ...DDR | .SGDAG..EV.G | A..A....... | 0.01 | 1 |
| ..... | ................. | .........NF...... | R...D. | E........... | A..A....... | 0.01 | 1 |
| ..... | F................. | .V........F...... | ...... | ........... | ESRAE..V.G.H | 0.01 | 1 |
| ..... | F................. | .V........F...... | ...... | ........... | GHRNS..FSI.T | 0.01 | 1 |
| AA... | F.....DA..IA.L.K.R | .KDSR....DF......T | R..DD. | ........... | A..A....... | 0.01 | 1 |
| D...T | F.....GGT.IV.K.G.K | ..DGE....DF...... | ...... | .SA.GG....DG | A..A....... | 0.01 | 1 |
| .A... | ................. | .........F...... | ...... | ........... | ATRNT..VDV.H | 0.01 | 1 |
| NT... | F......H..NV.T.G.R | .QHNQ.....F......T | ...D.. | ........... | A..A....... | 0.01 | 1 |
| ..... | F................. | .V........F...... | ...... | ........... | G..NA..DHV.H | 0.01 | 1 |
| ..... | ................. | ................. | G..ND. | .SAS.N.IA..E | A..A....... | 0.01 | 1 |
| ..... | ................. | ................. | ...DDR | .SANTG....GE | A..A....... | 0.01 | 1 |
| RA... | ................. | .QYGQ....DF......T | E..NGR | ........... | A..A....... | 0.01 | 1 |
| ..... | F.....SRG..L.P.G.G | .K.TG....DF...... | R...DR | .NAA...A..DD | A..A....... | 0.01 | 1 |
| RA... | ................. | TQHNG....NF......T | R..D.. | ........... | A..A....... | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F................. | .V........F....... | ...... | ........... | ARQSG..NGV.T | 0.01 | 1 |
| A...T | F.....GRG.H..P.E.R | TKDDR.....F......T | ...DG. | ........... | A..A........ | 0.01 | 1 |
| NT..T | F.....SA..RA.....R | .V........F....... | ...... | ........... | KDRTH..FDM.. | 0.01 | 1 |
| DT... | ................. | .Q.GQ....DF....... | ....G. | .NASEG..E..G | A..A........ | 0.01 | 1 |
| ..... | F................. | .V........F....... | ...... | ........... | GRHNP..SR..Q | 0.01 | 1 |
| ..... | ................. | .V........F....... | ...... | ........... | GRKTG..AEV.A | 0.01 | 1 |
| ..... | ................. | ................. | R...D. | .DARAADA...Q | A..A........ | 0.01 | 1 |
| ..... | F................. | .Q.......DF....... | ...AD. | ........... | A..A........ | 0.01 | 1 |
| GA... | ................. | .Q.S......F....... | E..ND. | ........... | A..A........ | 0.01 | 1 |
| ..... | ................. | ................. | ...DDR | .NATG....VGS | A..A........ | 0.01 | 1 |
| ..... | F................. | .V........F....... | ...... | ........... | AAKTP..AGG.A | 0.01 | 1 |
| D...T | F.......T.SV...H.R | .PPNG.....F......T | ...DDR | .NAGA.D.AFDE | A..A........ | 0.01 | 1 |
| ..... | ................. | .................T | ...ND. | ........... | A..A........ | 0.01 | 1 |
| N.... | F................. | .V........F....... | ...... | ........... | NE.NA..FDV.T | 0.01 | 1 |
| NT... | F.....GTT.IL.M...K | .Q.......DF....... | ...AD. | ........... | A..A........ | 0.01 | 1 |
| A.... | F.....AKG.P..H.P.R | .KDDG....NF......T | R...DR | E..GANDI..GS | A..A........ | 0.01 | 1 |
| ..... | ................. | ................. | ...DDR | E.AAAN.IEV.E | A..A........ | 0.01 | 1 |
| ..... | F......GG.NV...G.M | .Q.GQ....DF....... | ....G. | ........... | A..A........ | 0.01 | 1 |
| TA... | F................. | ................. | ....D. | ........... |  | 0.01 | 1 |
| ..... | F.........N....... | .V........F....... | ...... | ........... | GT.TR..FQM.E | 0.01 | 1 |
| E.... | F................. | ..HG.....NF......T | E..DD. | ........... |  | 0.01 | 1 |
| ..... | ................. | ................. | ...D.. | ES.SA..I..DR | A..A........ | 0.01 | 1 |
| SA... | F.....GKG.NQ...P.K | .V........F....... | ...... | ........... | A..A........ | 0.01 | 1 |
| ..... | ................. | ........NF......T | ...... | ESGTGND.E.DG | A..A........ | 0.01 | 1 |
| ..... | F.....DA..IA.L.K.R | .PPN......F......T | R..A.. | ........... | A..A........ | 0.01 | 1 |
| ..... | ................. | ................. | ...... | ESA.AG..E.GE | A..A........ | 0.01 | 1 |
| ..... | ...........K.R | ...T.....NF.....T | ...D.. | E.GT.G.T..GH | A..A........ | 0.01 | 1 |
| ..... | F......AG..L.T.N.R | T..NE....DF....... | ...DDR | H.AKGS.AAYDS | A..A........ | 0.01 | 1 |
| AT..T | F.....SA..RA.....R | .Q.S......F....... | E..N.. | ...G.SDI.FDE | A..A........ | 0.01 | 1 |
| ..... | F................. | .V........F....... | ...... | ........... | AQRNP....M.Q | 0.01 | 1 |
| ..... | ................. | ................. | R..DD. | .NGGAADAE..H | A..A........ | 0.01 | 1 |
| G...T | F.....AQ...A.L.... | ........NF........ | R...D. | ........... | A..A........ | 0.01 | 1 |
| ..... | ................. | ........F.......T | ...DDR | E..G.SDAA.GD | A..A........ | 0.01 | 1 |
| ..... | F................. | .V........F....... | ...... | ........... | ASRA...SG..A | 0.01 | 1 |
| .A... | ................. | TKAS.....NF......T | G.A.R | ........... | A..A........ | 0.01 | 1 |
| GA... | ................. | ................. | ...DDR | .NATG....VGS | A..A........ | 0.01 | 1 |

TABLE 3-continued

AAV capsid proteins having increased specificity for and/or transduction of CD447⁻/133⁻ GBM cells (pool of Round 1 selection). Amino acid numbers correspond to the amino acid sequence of VP1 (SEQ ID NO: 1). Sequences below correspond to SEQ ID NOs: 8 and 524.3691 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| AT..T | F.....ATG.NV.T.G.R | .QDT......F......T | ...D.. | ENAGASDIA.DH | A..A........ | 0.01 | 1 |
| G.... | ................. | .........NF....... | R..D. | ........... | A..A........ | 0.01 | 1 |
| DA... | F................ | ................. | ...... | ........... | A..A........ | 0.01 | 1 |
| ..... | F......AA.RH.L.Q.N | .Q.DH....NF....... | ....D. | E..AAS....GG | A..A........ | 0.01 | 1 |
| ..... | ................. | ................. | ...AGR | ........... | A..A........ | 0.01 | 1 |
| G...T | F......GT.NM.L.Q.G | .Q.S......F....... | ....D. | ........... | A..A........ | 0.01 | 1 |
| G.... | ................. | TQ.TG....DF....... | ...DDR | EDAA...AAVDQ | A..A........ | 0.01 | 1 |
| .T... | F.....AAT.N..P.P.R | TQADR....NF......T | R...D. | ........... | A..A........ | 0.01 | 1 |
| TA... | ................. | .PPNG.....F....... | E..KD. | ........... | A..A........ | 0.01 | 1 |
| .A... | F.....AGT.N..P.A.. | .KDSR....DF....... | R..DD. | ........... | A..A........ | 0.01 | 1 |
| ..... | F................ | .V........F....... | ...... | ........... | APQNP...DI.P | 0.01 | 1 |
| ..... | ................. | .K.TG....DF....... | R...DR | E.TAGN.IE.GE | A..A........ | 0.01 | 1 |
| .A... | F................ | .V........F....... | ...... | ........... | TTKGK..Y.E.E | 0.01 | 1 |
| D.... | F......AG.SH.T.A.R | T.P......DF....... | ...DDR | EDGAA.DAA.DE | A..A........ | 0.01 | 1 |
| TA..T | F.....NGT.IL.T.A.K | .Q.DH....NF....... | ...DD. | ..ARGADAE..S | A..A........ | 0.01 | 1 |
| ..... | F.....A.A.RE.I.... | .K.TG....DF....... | R...DR | ........... | A..A........ | 0.01 | 1 |
| E.... | p.....SN..PL.K.T.. | .........F..P.... | R..... | ........... | ........... | 0.01 | 1 |
| GT... | ................. | ................. | R..A.. | ........... | ........... | 0.01 | 1 |
| ..... | F................ | .V........F....... | ...... | ........... | GT.NA..FGV.D | 0.01 | 1 |
| TT..T | F.....DS..NH.I.P.R | .KYT.....NF......T | .....R | ENTSEG.....R | A..A........ | 0.01 | 1 |
| RA... | ......A...H......L | ..DGE....DF....... | ...... | ........... | ........... | 0.01 | 1 |
| A...T | P.......G.SE.N...R | .V........F....... | ...... | ..ATRD.T..GH | A..A........ | 0.01 | 1 |
| GA... | ................. | ..PNG....DF....... | R..AGR | ........... | A..A........ | 0.01 | 1 |
| ..... | ................. | ................. | ...... | .SAD.R....GG | A..A........ | 0.01 | 1 |
| SA... | F.....NET.P..K.K.G | TKYTG....DF....... | ...DDR | ........... | A..A........ | 0.01 | 1 |
| ..... | ................. | ................. | ...DDR | EN.DAS...V.E | A..A........ | 0.01 | 1 |
| A.... | F......QG.RL.L.T.R | .........NF....... | R...D. | .SAS.N.IA..E | A..A........ | 0.01 | 1 |
| ..... | ................. | ................. | ....G. | ..ASE...E.D. | A..A........ | 0.01 | 1 |
| ..... | ................. | ...............T | ...DDR | ........... | ASSNH..AKG.D | 0.01 | 1 |
| ..... | ................. | ..........F...... | ...DDR | ........... | A..A........ | 0.01 | 1 |
| ST... | F.....SGT.S..P.A.K | T.PG.....NF....... | ...DDR | ........... | A..A........ | 0.01 | 1 |
| RA... | ................. | .KAS.....NF......T | E..DD. | ..TGAS..EV.N | A..A........ | 0.01 | 1 |
| AA... | F.....ASA.S..T.T.G | .QPG.....DF....... | ...... | ESTTEA...... | A..A........ | 0.01 | 1 |
| ET..T | ................. | .KD.E....DF......T | ...... | E.AG..D.A.GR | A..A........ | 0.01 | 1 |

TABLE 4

AAV capsid proteins having increased specificity for and/or transduction of
CD44⁻/133⁻ GBM cells (pool of Round 2 selection). Amino acid numbers correspond
to the amino acid sequence of VP1 (SEQ ID NO: 1). Sequences below correspond
to SEQ ID NOs: 8 and 3692-3730 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F.....ASA.S..T.T.G | .QPG.....DF....... | ...D.. | ............ | ............ | 11.75 | 304 |
| ..... | ................ | .Q.S......F....... | ...T.. | ............ | A..A........ | 9.39 | 243 |
| ..... | ................ | ................ | R..DD. | ............ | ............ | 6.42 | 166 |
| ..... | ................ | ..DGE....DF....... | R...D. | ............ | ............ | 5.91 | 153 |
| ..... | ................ | TQASG....NF....... | ....D | E.AS...IEYGQ | A..A........ | 4.79 | 124 |
| ..... | ................ | ................ | ...... | .DTAAA...VGE | A..A........ | 4.56 | 118 |
| ..... | ................ | ................ | G..DG. | ............ | ............ | 4.41 | 114 |
| ..... | F.....DAA.IK.T.Q.N | ..DGE....DF....... | ...... | E........... | ............ | 4.14 | 107 |
| ..... | F................ | .V......F....... | ...... | ............ | DPHTR..D.M.. | 4.06 | 105 |
| ..... | ................ | ................ | ....GR | ..AG.N.AA.GA | A..A........ | 4.06 | 105 |
| ..... | ................ | ................ | R...GR | EDTG.A....GN | A..A........ | 4.02 | 104 |
| ..... | ................ | ................ | ....D | E.GGTG.AEFDQ | A..A........ | 3.75 | 97 |
| ..... | ................ | ................ | R...D. | ............ | A.KA........ | 2.82 | 73 |
| R.... | ................ | ................ | ....G | E.AG...IAVDR | A..A........ | 2.71 | 70 |
| ..... | ................ | ................ | ....DR | ESGTTA...VGQ | A..A........ | 2.71 | 70 |
| ..... | ................ | .QD.E.....F..P.... | ...D.. | ............ | ............ | 2.55 | 66 |
| ....T | ................ | ................ | ...ADR | ............ | A..A........ | 2.32 | 60 |
| GA... | F.....STA..Q.H.Q.L | T.P.....DF....... | R...D. | ............ | ............ | 2.16 | 56 |
| ..... | ................ | ................ | ....GR | ..AGA..AA.GS | A..A........ | 2.05 | 53 |
| ..... | ................ | ................ | ...AG. | ............ | A........... | 2.05 | 53 |
| ..... | ................ | ................ | ...D.R | ES.DGN..A.DG | A..A........ | 1.70 | 44 |
| SA... | ................ | ...........T | ...D.. | ............ | ............ | 1.66 | 43 |
| E.... | ................ | ................ | G..KD. | ............ | A..A........ | 1.39 | 36 |
| NA... | F.....SK..PA.K.A.H | .KPDQ.....F....... | R..DGR | ............ | A..A........ | 1.04 | 27 |
| A.... | ................ | .QD.E.....F..P.... | ...D.. | ............ | ............ | 0.89 | 23 |
| DT... | ................ | ........NF....... | ...DDR | ESGRR...E..Q | A..A........ | 0.43 | 11 |
| TT..T | F.....SGT.NM.K.T.E | .Q.GQ....DF....... | ....G. | ............ | A..A........ | 0.39 | 10 |
| G.... | ................ | .KD.E.....F..P...T | R..ND. | ............ | A..A........ | 0.19 | 5 |
| ....T | ................ | .........G........ | ...ADR | ............ | A..A........ | 0.08 | 2 |
| AT... | .......GT.NM.L.Q.G | .Q.S......F....... | ...D. | ............ | ............ | 0.08 | 2 |
| ..... | F.....ASA.S..T.TPG | .QPG.....DF....... | ...D.. | ............ | ............ | 0.08 | 2 |
| ..... | F................ | .V......F....... | ...... | .C.......... | .EKGG...QN.. | 0.08 | 2 |
| ..... | F.....DAA.IK.T.Q.N | ..DGE....DF....... | .....S | E........... | ............ | 0.08 | 2 |
| ..... | ................ | ....G....DF....... | E..AD. | ...SGSD..FDN | A..A........ | 0.04 | 1 |
| ..... | F................ | .V......F....... | ...... | ............ | GERTP..ART.D | 0.04 | 1 |
| G...T | ................ | ..HDR....NF....... | ....D. | ............ | A..A........ | 0.04 | 1 |

TABLE 4-continued

AAV capsid proteins having increased specificity for and/or transduction of CD44⁻/133⁻ GBM cells (pool of Round 2 selection). Amino acid numbers correspond to the amino acid sequence of VP1 (SEQ ID NO: 1). Sequences below correspond to SEQ ID NOs: 8 and 3692-3730 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ................. | ...... | .DAGGND.A.D. | A..A........ | 0.04 | 1 |
| ..... | ................. | ................. | E..NG. | ............ | ............ | 0.04 | 1 |
| ..... | ................. | ................. | ...... | .DTAAA...VGE | A..A........ | 0.04 | 1 |

TABLE 5

AAV capsid proteins having increased specificity for and/or transduction of CD44⁺/133⁺ GSC (pool of Round 1 selection). Amino acid numbers correspond to the amino acid sequence of VP1 (SEQ ID NO: 1). Sequences below correspond to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F................. | .V........F....... | ...... | ............ | ERSGA..IE..D | 10.81 | 1378 |
| ..... | ..........SP.H.E.V | ..HG.....NF......T | ...DDR | E.AGAND.AV.H | A..A........ | 6.51 | 830 |
| ..... | ................. | T.HTE....NF......T | ...NDR | ............ | A..A........ | 5.33 | 679 |
| ..... | ................. | ................. | ....GR | ..AG.N.AA.GQ | A..A........ | 1.70 | 217 |
| E.... | F.....ASA.S..T.T.G | .QPG.....DF....... | ...DDR | ............ | ............ | 0.92 | 117 |
| .A... | F.....DRG.S..T.A.S | ..DGE....DF....... | ...... | ............ | ............ | 0.88 | 112 |
| ..... | ................. | ................. | ...NDR | ..AKG...AV.. | A..A........ | 0.78 | 100 |
| ..... | F................. | .V........F....... | ...... | ............ | GRRDP..DTI.P | 0.75 | 96 |
| AA... | F.....GQG.IA.....K | .Q.GQ....DF....... | ....G. | .NAGA.D...GS | A..A........ | 0.64 | 82 |
| E.... | F.....ASA.S..T.T.G | .QPG.....DF....... | ...DDF | ............ | A..A........ | 0.60 | 76 |
| EA..T | ......NQG..V.L.N.R | .QPN......F......T | ...N.. | .NGGGN...VDQ | ............ | 0.58 | 74 |
| A.... | ................. | ................. | ...... | ............ | ............ | 0.53 | 68 |
| TT..T | ................. | ................. | ...... | ............ | ............ | 0.53 | 67 |
| ..... | ................. | ................. | R...D. | ............ | A..A........ | 0.49 | 63 |
| ..... | F......TG.KA.I.G.K | .PHD.....DF......T | ...D.R | ............ | A..A........ | 0.46 | 59 |
| ..... | ................. | ................. | ...DDR | ............ | ............ | 0.46 | 59 |
| ..... | ................. | ................. | ...... | ............ | A..A........ | 0.46 | 59 |
| GT... | ................. | ..HG.....NF......T | E..DD. | ............ | ............ | 0.46 | 58 |
| TA... | ................. | .QANH....DF....... | ...DDR | ............ | A..A........ | 0.45 | 57 |
| ..... | ................. | .PPNG.....F......T | ...DDR | E.ATRA..A.DE | A..A........ | 0.43 | 55 |
| ..... | ................. | .V........F....... | ...... | ............ | GR.DT..FTE.D | 0.42 | 53 |
| ..... | ................. | .QD.E....F..P.... | ...D.. | ............ | ............ | 0.35 | 44 |
| .A... | F.....G.T.II.P.F.R | ................. | ...DG. | ............ | A..A........ | 0.33 | 42 |
| ..... | ................. | T..NH....NF......T | ....GR | .DAGAN.AEVDH | A..A........ | 0.33 | 42 |
| GA... | ................. | ...............T | G..TG. | ............ | ............ | 0.31 | 40 |
| ..... | .......KA.SA.T.A.G | .QPN......F......T | ...N.. | ............ | A..A........ | 0.31 | 40 |
| ..... | F.....GDT.H..I...G | .QAS......F....... | G..DG. | ............ | ............ | 0.31 | 39 |

TABLE 5-continued

AAV capsid proteins having increased specificity for and/or transduction of CD44⁺/133⁺ GSC (pool of Round 1 selection). Amino acid numbers correspond to the amino acid sequence of VP1 (SEQ ID NO: 1). Sequences below correspond to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | .................. | G..DG. | ........... | ........... | 0.31 | 39 |
| ..... | .................. | .................. | ....GR | ........... | A..A........ | 0.30 | 38 |
| H.... | .................. | .........DF....... | ...D.. | ........... | .RQDP..NEA.T | 0.30 | 38 |
| D...T | F......GT.NM.L.Q.G | .Q.S.....F....... | ....D. | ........... | ........... | 0.30 | 38 |
| ..... | F................. | .V........F....... | ...... | ........... | ........... | 0.29 | 37 |
| ..... | .................. | .................T | G..TG. | ........... | ........... | 0.29 | 37 |
| ..... | .................. | .................. | R..DD. | ........... | A..A........ | 0.29 | 37 |
| ..... | .................. | .........DF....... | ...D.. | E.ASGG.A..GS | A..A........ | 0.29 | 37 |
| ..... | .................. | .................. | R..D.R | E.AAAA.I..D. | A..A........ | 0.29 | 37 |
| ..... | F.....AEG.LK.M.H.L | ..DGE....DF....... | ...... | ........... | ........... | 0.28 | 36 |
| ..... | .................. | .................. | R..D.. | ES.TG..I.FDR | A..A........ | 0.27 | 35 |
| TA... | F.....SRA.SG.N.A.H | .QDT.....DF....... | ...DDR | ...G.S..AFGD | A..A........ | 0.27 | 35 |
| A.... | F.....DA..IA.L.K.R | .KDSR....DF......T | R..DD. | ........... | A..A........ | 0.27 | 34 |
| ..... | .................. | .........DF....... | ...DDR | ESGTGA.A.FG. | A..A........ | 0.27 | 34 |
| ..... | .................. | .................. | E..NG. | ........... | ........... | 0.27 | 34 |
| R.... | F.....NKT.I..K.... | ..DGE....DF....... | ...... | E.AGAADA.VDH | A..A........ | 0.26 | 33 |
| ..... | .................. | .................. | ...... | .DGKTGD..VGE | A..A........ | 0.26 | 33 |
| G.... | F.....GS..NK.M.A.R | ..YN......F......T | ...D.R | ........... | A..A........ | 0.26 | 33 |
| ..... | F................. | .V........F....... | ...... | ........... | TSKDA..I.T.A | 0.26 | 33 |
| E.... | F.....ASA.S..T.T.G | ...T.....DF..P...T | ...DDR | ........... | ........... | 0.26 | 33 |
| ..... | .................. | .................. | ...NDR | ........... | A..A........ | 0.26 | 33 |
| ..... | .................. | .................. | G..ND. | E.GTR...A..S | A..A........ | 0.25 | 32 |
| ..... | .................. | .V........F....... | ...... | ENATRSDTE.DQ | A..A........ | 0.25 | 32 |
| GA... | F.....GDT.H..I...G | .QAS.....F....... | ...D.. | ........... | ........... | 0.25 | 32 |
| A.... | F................. | .V........F....... | ...... | ........... | E..A........ | 0.25 | 32 |
| AT... | .................. | .................. | E..ADR | .S.KA..TE.DS | A..A........ | 0.24 | 31 |
| RA... | .................. | .................. | E...G. | EN.NR..I...G | A..A........ | 0.24 | 31 |
| ..... | F......N..IL.T.T.R | .QPN......F......T | ...N.. | ........... | A..A........ | 0.24 | 31 |
| ..... | .................. | .........DF....... | E..ND. | ........... | A..A........ | 0.24 | 31 |
| H.... | F.....GRA.RQ.M.G.G | .Q.DR....F....... | ...DG. | ........... | A..A........ | 0.24 | 30 |
| ..... | .................. | .................. | R...DR | E.GG.....F.S | A..A........ | 0.24 | 30 |
| ..... | F................. | .V........F....... | ...... | ........... | AARGG.VSN... | 0.24 | 30 |
| SA... | .................. | .PPNG.....F......T | ...DDR | ........... | A..A........ | 0.24 | 30 |
| A.... | .................. | .QD.E.....F..P.... | ...D.. | ........... | ........... | 0.23 | 29 |
| T.... | F.....GK..LA.K.N.G | ..DGE....DF....... | ...... | ..AN.A..AV.D | A..A........ | 0.23 | 29 |
| ..... | F................. | .V........F....... | ...... | ........... | G.RTT..DRV.E | 0.22 | 28 |

TABLE 5-continued

AAV capsid proteins having increased specificity for and/or transduction of CD44$^+$/133$^+$ GSC (pool of Round 1 selection). Amino acid numbers correspond to the amino acid sequence of VP1 (SEQ ID NO: 1). Sequences below correspond to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F................. | .V........F....... | ...... | ........... | GR.DT..FTE.E | 0.22 | 28 |
| ..... | ................. | ................. | ...D.R | ........... | A..A........ | 0.22 | 28 |
| ..... | ................. | ................. | ...... | .DAGGND.A.D. | A..A........ | 0.22 | 28 |
| DT..T | F.....NG..LK.T.K.K | .QANH....DF....... | ...DDR | ........... | A..A........ | 0.22 | 28 |
| .A... | ................. | .KYT.....NF......T | E..TD. | ........... | A..A........ | 0.22 | 28 |
| ..... | ................. | ................. | G..KGR | ..AG.N.AA.GQ | A..A........ | 0.21 | 27 |
| TA... | F.....NN..SA.N...R | .KDDG....NF......T | ...DDR | .S.G.S.IA..G | A..A........ | 0.21 | 27 |
| ..... | ................. | ................. | E..DGR | ........... | ............ | 0.21 | 27 |
| .T... | ................. | ........NF..P...T | R..ND. | ........... | A..A........ | 0.21 | 27 |
| ..... | ................. | .Q.GQ....DF....... | R..AD. | ..ARGADAE... | A..A........ | 0.21 | 27 |
| TA... | F.....AQ...A.L.... | .QD.E.....F..P.... | ...... | ........... | ............ | 0.20 | 26 |
| ..... | ................. | ..AGR....DF......T | R..D.. | .D......... | A..A........ | 0.20 | 26 |
| RA... | F.....DGA.R..P.A.K | .........NF....... | R...D. | ........... | A..A........ | 0.20 | 25 |
| ..... | ................. | ................T | ....GR | ...AAS.A.VGQ | A..A........ | 0.20 | 25 |
| ..... | ................. | ................. | ...DD. | ........... | ............ | 0.20 | 25 |
| ..... | ................. | ................. | ...ND. | ..ATT..T.F.Q | A..A........ | 0.20 | 25 |
| ..... | ................. | ................. | R..ND. | ..ARAN..A.DR | A..A........ | 0.19 | 24 |
| ..... | F.....SR..NE.M...S | .QPSE....DF....... | ...DG. | ..ATESD..FDQ | A..A........ | 0.19 | 24 |
| T.... | F......KG.RV.T.A.G | .V........F....... | R..ADR | E.AGG.DI..GN | A..A........ | 0.19 | 24 |
| EA... | ................. | T..NE....DF......T | R..DD. | ........... | ............ | 0.19 | 24 |
| ..... | F................. | .V........F....... | ...... | ........... | E.KSP..ARA.. | 0.19 | 24 |
| ..... | F.....SA..RA.....R | TKDDR....DF....... | ...DDR | E..A.ADA..GD | A..A........ | 0.19 | 24 |
| ..... | F................. | .V........F....... | ...... | ........... | A.RAG..STI.H | 0.19 | 24 |
| ..... | ................. | .V........F....... | ...... | ........... | EKRGA..V...H | 0.18 | 23 |
| RT..T | F.....G.G.HA.T.G.R | TQPTE....DF....... | ...DDR | ........... | A..A........ | 0.18 | 23 |
| GA... | F.....STA..Q.H.Q.L | T.P......DF....... | R...D. | ........... | ............ | 0.18 | 23 |
| E.... | ................. | T..NH....NF......T | ....GR | .DAGAN.AEVDH | A..A........ | 0.18 | 23 |
| ..... | ................. | ................. | G..N.. | ..GAGAD..... | A..A........ | 0.17 | 22 |
| ..... | F.....SN..PL.K.T.. | .V........F....... | ...... | ........... | ............ | 0.17 | 22 |
| ..... | ................. | ................. | ...D.. | ENAG.G.IA.DG | A..A........ | 0.17 | 22 |
| ..... | ................. | ................. | R..DD. | ........... | ............ | 0.17 | 22 |
| A.... | F.....AG..PA.K.G.R | ..A......DF....... | ....D. | ........... | A..A........ | 0.17 | 22 |
| .T... | ................. | ........NV..P...T | R..ND. | ........... | A..A........ | 0.17 | 22 |
| ..... | ................. | ........DF....... | ...D.. | ........... | .RQDP..NEA.T | 0.17 | 22 |
| GT... | ................. | ................. | R...D. | ........... | ............ | 0.17 | 22 |
| DT... | F.....AG..SD.L...K | .KDSR....DF....... | E..ND. | ........... | A..A........ | 0.16 | 21 |

TABLE 5-continued

AAV capsid proteins having increased specificity for and/or transduction of
CD44[+]/133[+] GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | .................. | .................. | ...... | E..TGS..EYDR | A..A........ | 0.16 | 21 |
| ..... | .................. | .........DF....... | R...D. | .S.GGA.IE.DD | A..A........ | 0.16 | 21 |
| ..... | .................. | .................. | E..AD. | ........... | ........... | 0.16 | 21 |
| G.... | F......G..NL.T.E.R | .QDT......F......T | ...D.. | ........... | A..A.....T | 0.16 | 21 |
| ..... | F.....STA..Q.H.E.L | T.P......DF....... | R...D. | ........... | ........... | 0.16 | 21 |
| ..... | F................. | .V.......F....... | ...... | ........... | S.HT...FGG.T | 0.16 | 21 |
| .A..T | .................. | .........DF....... | ...AD. | ........... | A..A........ | 0.16 | 21 |
| ..... | ......SG..IK.K.D.R | .KPDQ....DF....... | ...D.. | .NATG....VGS | A..A........ | 0.16 | 21 |
| GT... | .................. | .................. | E..ADR | .S.KA..TE.DS | A..A........ | 0.16 | 21 |
| ..... | .................. | ...............T | ...D.. | ........... | ........... | 0.16 | 20 |
| ..... | .................. | .........NF....... | R...D. | ESASTN...VDQ | A..A........ | 0.16 | 20 |
| TA... | F................. | .V.......F....... | ...... | ENAAGGDT..GR | A..A........ | 0.16 | 20 |
| ..... | .................. | .................. | ...DDR | E.ANR..IA.GE | A..A........ | 0.16 | 20 |
| E.... | F.....AT..PL.H.G.N | ..DD.....DF....... | ...ND. | ........... | ........... | 0.16 | 20 |
| ..... | .................. | ..AG.....NF......T | R..DF. | ........... | A..A........ | 0.16 | 20 |
| AA... | F.....DAA.SA.K.A.R | .Q.GQ....DF....... | ....G. | E..N...I..DR | A..A........ | 0.16 | 20 |
| ..... | .................. | .................. | ...DDR | .SGGRS..E.DQ | A..A........ | 0.16 | 20 |
| ..... | F................. | .V.......F....... | ...... | ........... | GPSNR..IEI.D | 0.16 | 20 |
| A.... | F.....NGT.HV.T.K.N | T.YNG....DF....... | ...DG. | ESAR..DAA.DD | A..A........ | 0.15 | 19 |
| ..... | F................. | .V.......F....... | ...... | ........... | TPRSG..FT..H | 0.15 | 19 |
| ..... | .................. | .................. | ...DDR | ...GT..AA.GD | A..A........ | 0.15 | 19 |
| ..... | .................. | .................. | ...DG. | ........... | A..A........ | 0.15 | 19 |
| ..... | .................. | .................. | ...DDR | .N.G.N.A.VDN | A..A........ | 0.15 | 19 |
| ..... | .................. | ...........NF | ...NDR | ........... | A..A........ | 0.15 | 19 |
| ..... | .................. | .................. | R..N.. | ........... | A..A........ | 0.15 | 19 |
| ..... | F................. | .V.......F....... | ...... | ........... | APQDR..DTN.T | 0.15 | 19 |
| T.... | .................. | .KDT......F......T | ...DD. | ESGA.A.AAV.H | A..A........ | 0.15 | 19 |
| ..... | .................. | .................. | R..DD. | .DTG.GD.A..H | A..A........ | 0.15 | 19 |
| TT... | F.....ARG.IA.K.E.L | .QPN......F......T | ...N.. | EDGKGN..AFDE | A..A........ | 0.15 | 19 |
| ..... | F.....GNG.HV.H.G.R | ..YN......F......T | ...D.R | ........... | A..A........ | 0.15 | 19 |
| ..... | .................. | .V.......F....... | ...... | ........... | GRRDP..DTI.P | 0.15 | 19 |
| E.... | .................. | .................. | E..A.. | ........... | A..A........ | 0.15 | 19 |
| ..... | F................. | .V.......F....... | ...... | ........... | S.QDR..D.N.A | 0.15 | 19 |
| AA... | F.....NAT.LV.T.H.R | .Q.......DF....... | ...AD. | ........... | A..A........ | 0.15 | 19 |
| AA... | F.....GS..NK.M.A.R | ..YN......F......T | ...D.R | ........... | A..A........ | 0.15 | 19 |
| R.... | F.....A...ND.T...K | TPPG.....DF....... | R..DD. | .DAGGND.A.D. | A..A........ | 0.14 | 18 |

TABLE 5-continued

AAV capsid proteins having increased specificity for and/or transduction of
CD44$^+$/133$^+$ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | .................. | E..ND. | ............ | A..A........ | 0.14 | 18 |
| ..... | .................. | .................. | R..ND. | .DGSGG.TE.DG | A..A........ | 0.14 | 18 |
| ..... | .................. | .................. | E..T.. | ............ | ............ | 0.14 | 18 |
| ..... | .................. | .................. | T..AGR | .DAG.A.I..DG | A..A........ | 0.14 | 18 |
| RA... | F.....DTG.SK.T.T.R | .Q.S.....F....... | ...D.. | .NGR.G..A..E | A..A........ | 0.14 | 18 |
| NA..T | F.....GGG.RP.T.G.L | .Q.S.....F....... | E..N.. | ............ | A..A........ | 0.14 | 18 |
| ..... | .................. | .................. | ...DDR | E..GRD.IA.DH | A..A........ | 0.14 | 18 |
| E.... | F.....DRG.N..I.A.K | .KYT.....NF....... | R..D.. | ............ | ............ | 0.14 | 18 |
| ..... | F................. | .V........F....... | ...... | ........E... | TARTT..FKV.D | 0.14 | 18 |
| ..... | .................. | ...DG....DF......T | ...DDR | .DARRN.AE.GS | A..A........ | 0.14 | 18 |
| ..... | .................. | .Q.G.....F..P.... | ...... | .SASEN....GR | ............ | 0.14 | 18 |
| ..... | .................. | .................. | ...D.. | EDAGGS.TE.DQ | A..A........ | 0.14 | 18 |
| ..... | .................. | .................. | R..DG. | ENAGT...AFD. | A..A........ | 0.14 | 18 |
| ..... | .................. | .QPN......F......T | E..AD. | ............ | A..A........ | 0.14 | 18 |
| ..... | F................. | .V........F....... | ...... | ............ | SDRT.....A.D | 0.14 | 18 |
| ..... | .................. | .................. | ....D. | ESA.GG..E.GS | A..A........ | 0.13 | 17 |
| ..... | .................. | .................. | ...DDR | E.TG.N.AA.GQ | A..A........ | 0.13 | 17 |
| T...T | F.....N.G.RE.H.A.R | .Q.DR.....F....... | ....D. | ............ | A..A........ | 0.13 | 17 |
| ..... | .................. | .........F......T | R...G. | .NASEN...FDR | ............ | 0.13 | 17 |
| ..... | .................. | .........DF....... | ...D.. | ..TTTGDTA.DN | A..A........ | 0.13 | 17 |
| NA..T | .................. | .........DF....... | ...D.. | .D..TA....GE | A..A........ | 0.13 | 17 |
| A.... | F.....DNT.SK.L...K | .Q.DQ.....F....... | ...DD. | .DA..N..A..E | A..A........ | 0.13 | 17 |
| ..... | .................. | .................. | ...... | ..GSRN..EYGE | A..A........ | 0.13 | 17 |
| ..... | .................. | .................. | R..... | ............ | A..A........ | 0.13 | 17 |
| .T... | .................. | .QPSQ....NF....... | ...... | ENGK.D..A.DG | A..A........ | 0.13 | 17 |
| GA... | .................. | TQ.TG....DF....... | ...DDR | E..KAS..AVDH | A..A........ | 0.13 | 17 |
| D.... | .................. | .........NF......T | R..TG. | .DGG.....Y.Q | A..A........ | 0.13 | 17 |
| G.... | .................. | .KYT.....NF....... | E..NG. | ENTTGN....DR | A..A........ | 0.13 | 17 |
| ..... | .................. | .Q.DR.....F....... | ....D. | ............ | A..A........ | 0.13 | 17 |
| GT... | .................. | .................. | R...D. | E.A.AN.TAY.Q | A..A........ | 0.13 | 16 |
| RA... | F.....G.G.HA.T.G.R | .Q.GQ....DF....... | R...D. | .DGTGA..E..E | A..A........ | 0.13 | 16 |
| E.... | F.....SN..PL.K.T.. | .........F..P.... | R..... | ............ | ............ | 0.13 | 16 |
| ..... | F................. | .................. | ...NDR | ..AKG...AV.. | A..A........ | 0.13 | 16 |
| ..... | F................. | .V........F....... | ...... | ............ | .AHTG...RE.A | 0.13 | 16 |
| D...T | F.....D...S..M.T.R | .................. | ...... | ............ | A..A........ | 0.13 | 16 |
| ..... | .................. | .................. | ....G. | ............ | A..A........ | 0.13 | 16 |

TABLE 5-continued

AAV capsid proteins having increased specificity for and/or transduction of CD44+/133+ GSC (pool of Round 1 selection). Amino acid numbers correspond to the amino acid sequence of VP1 (SEQ ID NO: 1). Sequences below correspond to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| .A... | F.....SA..RA.....R | T.P......DF....... | ...D.. | ........... | A..A........ | 0.13 | 16 |
| ..... | ................. | .QAS.....NF....... | ....GR | ........... | A..A........ | 0.13 | 16 |
| ..... | F................ | .V.......F....... | ...... | ........... | AQQNP..IRG.A | 0.13 | 16 |
| T...T | ................. | ..A......DF....... | ...DG. | EDAGT...AFD. | A..A........ | 0.13 | 16 |
| ..... | ................. | ................. | ...DDR | ........... | A..A........ | 0.13 | 16 |
| ..... | F................ | .V.......F....... | ...... | ........... | EPRGN..IKV.D | 0.13 | 16 |
| ..... | ................. | ................. | ....GR | E.GG.....F.S | A..A........ | 0.13 | 16 |
| E.... | ................. | .QANH....DF....... | R..AD. | ........... | A..A........ | 0.13 | 16 |
| ..... | ................. | .Q.......DF....... | E..KG. | E..G.D.IAF.. | A..A........ | 0.13 | 16 |
| .A... | F.....AAG.S..P...R | T.DNE....NF....... | ...DD. | ..A.EGD.E... | A..A........ | 0.13 | 16 |
| ..... | ................. | ................. | ...DDR | ENGGTA.I..GS | A..A........ | 0.12 | 15 |
| ..... | F................ | .V.......F....... | ...... | ........... | GNRDP..SRE.P | 0.12 | 15 |
| ..... | ................. | ................. | ...ADR | ........... | A..A........ | 0.12 | 15 |
| TA... | F.....AGG.IV.L.G.R | .QAS......F....... | ...... | ........... | TRRTE..FEG.A | 0.12 | 15 |
| E.... | F.....ARG.PQ.N.G.G | ..HG.....NF......T | ...DD. | ........... | A..A........ | 0.12 | 15 |
| .A... | F.....NGG.NN.K.T.R | .V.......F....... | ...... | ........... | A..A........ | 0.12 | 15 |
| ..... | F................ | .V.......F....... | ...... | ........... | GTRTP..VR..T | 0.12 | 15 |
| ..... | ................. | T..NH....NF......T | ....GR | .DAGAN.AEVGE | A..A........ | 0.12 | 15 |
| ..... | ................. | ...SH....DF....... | ...... | E..GGSDIAF.G | A..A........ | 0.12 | 15 |
| SA... | ......SA..RA.....R | .QHNQ.....F......T | ...N.. | ..AGADD.EYDE | A..A........ | 0.12 | 15 |
| ..... | ................. | ................. | ....D. | ES.TED....GR | A..A........ | 0.12 | 15 |
| ..... | F................ | .V.......F....... | ...... | ........... | NRQDG..FSG.T | 0.12 | 15 |
| NT... | ................. | ................. | E..DG. | ........... | A..A........ | 0.11 | 14 |
| .A... | ................. | ................. | E..ND. | ........... | A..A........ | 0.11 | 14 |
| E.... | ................. | ................. | E..ADR | .S.KA..TE.DS | A..A........ | 0.11 | 14 |
| ..... | ................. | ................. | ....GR | E.AAGD.I.V.R | A..A........ | 0.11 | 14 |
| ..... | F................ | .V.......F....... | ...... | ........... | NPRAP..SET.A | 0.11 | 14 |
| ..... | ................. | ................. | E..TG. | ........... | ............ | 0.11 | 14 |
| ..... | ................. | ................. | ....GR | EDAGT..AA..H | A..A........ | 0.11 | 14 |
| GA... | ................. | ................T | E..AD. | ..A.ASDA.V.Q | A..A........ | 0.11 | 14 |
| R.... | F.....NGG.NN.K.T.R | ........NF....... | R...D. | .DTG.GD.A..H | A..A........ | 0.11 | 14 |
| ..... | F................ | .V.......F....... | ...... | ........... | GTQSP..F.S.P | 0.11 | 14 |
| GT..T | ................. | ..A......DF....... | ...DG. | E.AAA..A.FG. | A..A........ | 0.11 | 14 |
| ..... | ................. | ................. | R...DR | ESTN....A..R | A..A........ | 0.11 | 14 |
| TA... | ................. | ................. | ....D. | .D.TGN.I...Q | A..A........ | 0.11 | 14 |
| ..... | F................ | .V.......F....... | ...... | ........... | G.RNP..SSA.H | 0.11 | 14 |

TABLE 5-continued

AAV capsid proteins having increased specificity for and/or transduction of CD44⁺/133⁺ GSC (pool of Round 1 selection). Amino acid numbers correspond to the amino acid sequence of VP1 (SEQ ID NO: 1). Sequences below correspond to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | .................. | .................. | ...DDR | ED.R.S.A...G | A..A........ | 0.11 | 14 |
| DR... | F.....ATT.IM.T.T.R | .........NF....... | R..ND. | ENAG.ND.E.DH | A..A........ | 0.11 | 14 |
| ..... | .................. | .................. | ...DDR | ES.DRN.....Q | A..A........ | 0.11 | 14 |
| ..... | .................. | .................. | E..NG. | ............ | A..A........ | 0.11 | 14 |
| ..... | .................. | ..........NF....... | ...D.. | E.AAGD.TA..G | A..A........ | 0.11 | 14 |
| TA... | F.....GK..LA.K.N.G | T.PNE....DF....... | R...D. | ............ | A..A........ | 0.11 | 14 |
| R.... | F.....GDG...K.Q.R | TKDDR....DF....... | ...DDR | ..GGA.D.E.GN | A..A........ | 0.11 | 14 |
| ..... | .................. | ..YG.....DF..P...T | R..ND. | ..TGRAD.A.DE | A..A........ | 0.11 | 14 |
| ..... | .................. | .................. | G..TD. | ............ | A..A........ | 0.11 | 14 |
| HT... | .................. | ..HG.....NF......T | ....A. | ............ | A..A........ | 0.11 | 14 |
| EA... | F.....GRT.ND.L.Q.R | .Q.G.....NF......T | E..NG. | .NAGA.D...GS | A..A........ | 0.11 | 14 |
| ..... | .................. | .................. | G..KD. | ............ | A..A........ | 0.11 | 14 |
| ..... | .................. | ................T | R..TG. | ESAN...I...H | A..A........ | 0.11 | 14 |
| ..... | .................. | .................. | R..A.. | ............ | A..A........ | 0.11 | 14 |
| RA..T | F.....GN..HM.P.... | ..DNH....NF....... | R...D. | ............ | A..A........ | 0.11 | 14 |
| ..... | .................. | .........NF......T | ...DDR | ESGGTDDA..DE | A..A........ | 0.10 | 13 |
| ..... | F................. | .V........F....... | ...... | ............ | A..A........ | 0.10 | 13 |
| ..... | .................. | .................. | G..K.. | .SADGSD..... | A..A........ | 0.10 | 13 |
| G.... | .................. | .Q.S......F....... | E..N.. | E.AS.N.IE.GS | A..A........ | 0.10 | 13 |
| GA... | .................. | ..PNH....NF......T | R..DG. | ............ | A..A........ | 0.10 | 13 |
| ..... | .................. | TQDTQ....NF....... | ...... | ............ | A..A........ | 0.10 | 13 |
| R.... | .................. | .................. | ....G. | E.AG...IAVDR | A..A........ | 0.10 | 13 |
| ..... | .................. | ..PGR....DF....... | ...D.. | E.GDGS...F.R | A..A........ | 0.10 | 13 |
| ..... | F................. | .V........F....... | ...... | ............ | NQRTH..NNM.D | 0.10 | 13 |
| ..... | F................. | T..NH....NF......T | ....GR | .DAGAN.AEVDH | A..A........ | 0.10 | 13 |
| G...T | F.....SGT.SQ.K.E.. | .KYT.....NF......T | ...DDR | ............ | ............ | 0.10 | 13 |
| TA... | .................. | ...TE.....F....... | ...NGR | ..AATD.AA.DQ | A..A........ | 0.10 | 13 |
| N.... | F.....GKG.S..M.K.M | .Q.......DF....... | ...AD. | ............ | A..A........ | 0.10 | 13 |
| SA... | .................. | ..DGE....DF....... | ...... | ENASGG.AE.DS | A..A........ | 0.10 | 13 |
| DT... | F.....NKT.HL.T.A.R | ..DGE....DF....... | ...DD. | .SAS.N.IA..E | A..A........ | 0.10 | 13 |
| A.... | F.....NGG.HN.K.G.. | TKDDR....DF....... | ...DDR | EDAGT...AFD. | A..A........ | 0.10 | 13 |
| ..... | F................. | .V........F....... | ...... | ............ | ..SNH..AKE.H | 0.10 | 13 |
| ..... | .................. | ..........F....... | ...... | ............ | TQKSE..FRT.H | 0.10 | 13 |
| A.... | F.....GKA.SE.N...K | T.AG.....NF......T | ...N.. | ............ | A..A........ | 0.10 | 13 |
| TA... | F.....AKG.P..H...G | .Q.S......F....... | E..N.. | ............ | A..A........ | 0.10 | 13 |
| GA..T | F.....ATT.NV.T.K.S | .KDHH.....F....... | R...D. | ..A.AN..AF.D | A..A........ | 0.10 | 13 |

TABLE 5-continued

AAV capsid proteins having increased specificity for and/or transduction of
CD44$^+$/133$^+$ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | ................. | ................. | R...D. | E.GAR.D.E.GE | A..A........ | 0.10 | 13 |
| ..... | ................. | ................. | E..... | ............ | GPRTT..VDA.T | 0.10 | 13 |
| ..... | ................. | .Q.DH...NF....... | ...DD. | .SAKAA.AA.DE | A..A........ | 0.10 | 13 |
| ..... | F................ | .V.......F....... | ...... | ............ | GHRAT..ND... | 0.10 | 13 |
| EA... | ................. | ...TE...DF....... | ...... | .NGST.....GG | A..A........ | 0.10 | 13 |
| TA... | ................. | TQPTH...NF....... | R..DD. | .NGG.ND....Q | A..A........ | 0.09 | 12 |
| H.... | F................ | ..AGR.....F......T | ...T.. | ............ | A..A........ | 0.09 | 12 |
| GT... | F.....ST..SV.K.H.M | .........DF....... | ...D.R | .SAKAA.AA.DE | A..A........ | 0.09 | 12 |
| ..... | ................. | ................. | ...DDR | .NGST.....GG | A..A........ | 0.09 | 12 |
| ..... | F................ | .V.......F....... | ...... | ............ | GRRD...VRM.T | 0.09 | 12 |
| ..... | F.....NGT.IL.T.A.K | .QPG.....NF....... | ...DDR | ............ | A..A........ | 0.09 | 12 |
| ..... | F.....GRG.H..P.E.R | .QPTG....NF....... | E..TG. | ............ | A..A........ | 0.09 | 12 |
| ..... | ................. | ................. | ...DDR | ...NAND.AY.G | A..A........ | 0.09 | 12 |
| ..... | ................. | ................. | ...DDR | ..ATG..I.F.R | A..A........ | 0.09 | 12 |
| ..... | ................. | ..DDG....NF..P.... | R..DD. | EN...A..EVGE | A..A........ | 0.09 | 12 |
| ..... | ..........A.N...R | .KYT.....NF......T | R...D. | ...G.D..EVGQ | A..A........ | 0.09 | 12 |
| ..... | ................. | ................. | ...DG. | .SAS.N.I..GD | A..A........ | 0.09 | 12 |
| ..... | F.....DKA.H..P.H.G | .QPSQ....DF....... | ....D. | .........D. | A..A........ | 0.09 | 12 |
| ..... | ................. | .........DF....... | ...DDR | ...T.G..A..Q | A..A........ | 0.09 | 12 |
| DA... | F.....AST.HD.T.E.R | T.PGG....NF....... | ...DDR | ESAKTSDAAVDD | A..A........ | 0.09 | 12 |
| ..... | F................ | .V.......F....... | ...... | ............ | SRQNG..F.A.T | 0.09 | 12 |
| R.... | ................. | ..AGR....DF......T | R..D.. | .D......... | A..A........ | 0.09 | 12 |
| ..... | F................ | .........NF....... | R...D. | E..G.A..A.D. | A..A........ | 0.09 | 12 |
| S.... | F.....AGT..M.K.Q.G | .PPNG.....F......T | ...DDR | ............ | A..A........ | 0.09 | 12 |
| GT... | F.....NKT.HL.T.A.R | .V.......F....... | ...... | ............ | A..A........ | 0.09 | 12 |
| ..... | ................. | ...TG....NF......T | R..DD. | ............ | A..A........ | 0.09 | 12 |
| RA... | F.....NGG.NN.K.T.R | TKPSG....DF....... | ...D.. | .DARGND.EFGE | A..A........ | 0.09 | 12 |
| ..... | ................. | ................. | R..DD. | ..TENSD..... | A..A........ | 0.09 | 12 |
| .A... | ................. | TQASG.....F....... | ...DDR | ESG..N.I..DG | A..A........ | 0.09 | 12 |
| ..... | ................. | ................. | ...DDR | EDAG...I..GQ | A..A........ | 0.09 | 12 |
| ..... | ................. | ................. | ...DGR | ...TG..T..GQ | A..A........ | 0.09 | 11 |
| ..... | ................. | ................. | ....D. | ENTATDD...GH | A..A........ | 0.09 | 11 |
| ..... | ................. | .........DF..P...T | ...AD. | ............ | A..A........ | 0.09 | 11 |
| ..... | ................. | ................. | ...... | ............ | GRRDP..DRI.P | 0.09 | 11 |
| ....T | ................. | ................. | G..K. | .SADGSD...DR | A..A........ | 0.09 | 11 |
| .A... | F.....DHT.R..M.G.R | ................. | ...... | ............ | A..A........ | 0.09 | 11 |

TABLE 5-continued

AAV capsid proteins having increased specificity for and/or transduction of
CD44+/133+ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | ................. | .KYT.....NF......T | ...ND. | ED.R.S.A...G | A..A........ | 0.09 | 11 |
| ..... | ................. | TQYT.....NF......T | ...D.. | ............ | A..A........ | 0.09 | 11 |
| .A... | F......GT.NM.L.Q.G | .Q.S......F....... | ...... | ............ | SR.DR..FNG.T | 0.09 | 11 |
| DA... | F................. | .V........F....... | ...... | ............ | A.RAG..STI.H | 0.09 | 11 |
| GA... | F......S..PM.T.S.K | ..HG.....NF......T | ...A.. | ..AGAN...FGE | A..A........ | 0.09 | 11 |
| AA... | F.....DKG.HM.L.G.R | TKDDR....DF....... | ...DDR | ...TG.D.AY.G | A..A........ | 0.09 | 11 |
| ..... | F....AGA.NK.L...K | TQASG............ | ...DDR | ED.R.S.A...G | A..A........ | 0.09 | 11 |
| NA... | ......AT...N.T...G | .QPG.....NF....... | ...... | EDGSG.DI.F.G | A..A........ | 0.09 | 11 |
| SA... | ......NQG....P.K.I | .Q.DR.....F....... | ....D. | ESGG.GDA.F.G | A..A........ | 0.09 | 11 |
| ..... | ................. | ..YN......F......T | R...G. | E.GSTSDAEFDQ | A..A........ | 0.09 | 11 |
| ..... | ................. | ................. | ...T.. | .SAKAA.AA.DE | A..A........ | 0.09 | 11 |
| ..... | ................. | ................. | ...... | .NGR..DAEV.H | A..A........ | 0.09 | 11 |
| NT... | ................. | .KYT.....DF....... | ...... | EN.KGGD.AFDN | A..A........ | 0.09 | 11 |
| ..... | ................. | ................. | R..ND. | .N.GA.D.A.GG | A..A........ | 0.09 | 11 |
| A.... | F.....G...I..M.A.G | ................. | ....GR | E.AGGN..E.DD | A..A........ | 0.09 | 11 |
| ..... | ................. | ................. | G..DD. | E.AG...TAVGN | A..A........ | 0.09 | 11 |
| A.... | ................. | ................. | E..TGR | ............ | A..A........ | 0.09 | 11 |
| NT..T | F......G..HP.T.Q.R | TKDT.....NF....... | R...D. | ..GGA.D.E.GN | A..A........ | 0.09 | 11 |
| NA... | ................. | TQADR....NF......T | G..ND. | ............ | A..A........ | 0.09 | 11 |
| ..... | ................. | T.AG.....NF......T | ...... | .D.GGGD.EVDE | A..A........ | 0.09 | 11 |
| HT..T | F.....NGG.NV.N.K.G | .........NF....... | R...D. | ............ | A..A........ | 0.09 | 11 |
| ..... | ................. | ................. | E..A.. | ............ | A..A........ | 0.09 | 11 |
| ..... | F................. | .V........F....... | ...... | ............ | GASNG..VDI.H | 0.09 | 11 |
| ..... | F.....DTG.SK.T.T.R | .Q.DR.....F....... | ....D. | ............ | A..A........ | 0.09 | 11 |
| DA..T | F.....AGT.RD.M.A.L | ..HG.....NF......T | ...A.. | ............ | A..A........ | 0.09 | 11 |
| ..... | ................. | .V........F....... | ...... | ............ | TDRAG..ST..Q | 0.09 | 11 |
| EA..T | F.....ANG.HL.K.K.S | ..DGE....DF....... | ...D.. | ............ | A..A........ | 0.08 | 10 |
| RA... | F.....DTA.N....E.R | T.P......DF....... | ...DDR | ..GGGS..A.DG | ............ | 0.08 | 10 |
| ..... | F................. | .V........F....... | ...... | ............ | ADRSG..ISV.Q | 0.08 | 10 |
| ..... | ................. | ................. | ...DDR | E.GG.....FD. | A..A........ | 0.08 | 10 |
| ST... | ................. | T.AT.....NF......T | ...DG. | E.TG.GD.A.GE | A..A........ | 0.08 | 10 |
| TA..T | F.....SKT.NE.P...M | .QHNQ....NF......T | ....GR | .NAGA.D.AFDE | A..A........ | 0.08 | 10 |
| ..... | ................. | ................. | ...DDR | EDAGGN.I.VDR | A..A........ | 0.08 | 10 |
| ..... | ................. | .........NF....... | G..TDR | E.AGGN..E.DD | A..A........ | 0.08 | 10 |
| TA..T | F.....ATG.S...P.... | .V........F....... | ...... | EDAGGS.AEYD. | A..A........ | 0.08 | 10 |
| ..... | ................. | ................. | ...... | .NGSAS..A.DN | A..A........ | 0.08 | 10 |

TABLE 5-continued

AAV capsid proteins having increased specificity for and/or transduction of CD44⁺/133⁺ GSC (pool of Round 1 selection). Amino acid numbers correspond to the amino acid sequence of VP1 (SEQ ID NO: 1). Sequences below correspond to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F..........K.M.Q.N | ..DGE....DF....... | ...... | ........... | ........... | 0.08 | 10 |
| G.... | ................. | .QDT.....DF....... | G..DG. | ........... | ........... | 0.08 | 10 |
| ..... | ................. | ................. | ...DDR | ENATAGDAA.GD | A..A........ | 0.08 | 10 |
| E.... | F................ | ................T | G..D.R | ........... | A..A........ | 0.08 | 10 |
| ..... | F.....SG..IK.K.D.R | ................. | ...... | EDAGAND.AV.H | A..A........ | 0.08 | 10 |
| ..... | F................ | .V.......F....... | ...... | ........... | GNRTP..NQV.Q | 0.08 | 10 |
| ..... | ................. | ................. | R..DDR | ..AA.D.IA... | A..A........ | 0.08 | 10 |
| ....T | ................. | ................. | G..TDR | E.AGGN..E.DS | ........... | 0.08 | 10 |
| ..... | ................. | ..........NF | ...D.. | .DASGS....GG | A..A........ | 0.08 | 10 |
| ..... | F................ | .V.......F....... | ...... | ........... | DRQGN..IGV.. | 0.08 | 10 |
| ..... | ................. | ................. | ...A.. | ........... | A..A........ | 0.08 | 10 |
| ..... | ................. | ..DGE....DF....... | ...... | E........... | A..A........ | 0.08 | 10 |
| EA... | ................. | ..........NF | R...D. | .NGRTGDA.V.Q | A..A........ | 0.08 | 10 |
| ..... | F................ | .V.......F....... | ...... | ........... | GQRD...AQT.Q | 0.08 | 10 |
| ..... | F................ | .V.......F....... | ...... | ........... | T.RNP..VKE.Q | 0.08 | 10 |
| TA..T | F.....NGG.IM.L.E.R | T.P......DF....... | ....D. | ........... | ........... | 0.08 | 10 |
| ..... | ................. | ..........DF | ...... | ..ATAA..AVDN | A..A........ | 0.08 | 10 |
| TA... | ................. | .KDSR....DF....... | R..DD. | ..AAE.D....N | A..A........ | 0.08 | 10 |
| DT... | ................. | ................. | E..ND. | ........... | ........... | 0.08 | 10 |
| ..... | ................. | ................. | ...D.. | ........... | A..A........ | 0.08 | 10 |
| ..... | ................L | .QAS......F....... | R..ND. | ........... | A..A........ | 0.08 | 10 |
| GA... | F.....SGT.S..T.T.. | .KYT.....NF......T | R..AGR | ........... | A..A........ | 0.08 | 10 |
| TT... | F.....DAA.SA.K.A.R | .PPNG.....F......T | ...DDR | ........... | A..A........ | 0.08 | 10 |
| ..... | ................. | .Q.GQ....DF....... | R..TDR | .DAG.S.A..DR | A..A........ | 0.08 | 10 |
| ..... | ................. | ................. | ...N.. | ........... | A..A........ | 0.08 | 10 |
| GT... | F.....AEG.LK.M.H.L | ..DGE....DF....... | ...... | ........... | ........... | 0.08 | 10 |
| ..... | F................ | .V.......F....... | ...... | ........... | ERRNP..F.T.T | 0.08 | 10 |
| G.... | ................. | .QYT.....NF......T | R...D. | ENGGAAD.A..N | A..A........ | 0.08 | 10 |
| ..... | F.....DQ..R..P.S.R | .QD.E....F..P.... | ...... | E.GKGSD...GG | A..A........ | 0.08 | 10 |
| ..... | ................. | TQASG....NF....... | ....D. | E.AS...IEYGQ | A..A........ | 0.08 | 10 |
| AA... | F.....SGT.NM.K.T.E | ..HG.....NF......T | R..DD. | .SAKAA.AA.DE | A..A........ | 0.08 | 10 |
| TT..T | ................. | .QHNQ.....F | ...... | ........... | A..A........ | 0.08 | 10 |
| R.... | F.....ATG.NN.I.S.G | .AGR....DF......T | R..D.. | ........... | A..A........ | 0.08 | 10 |
| D.... | F.....DKG..L.N...R | .Q.DR........... | ...DDR | ........... | A..A........ | 0.08 | 10 |
| DT... | F.....NGT.HN.K.G.K | .PDR.....F......T | ...... | .DAGGND.A.D | A..A........ | 0.08 | 10 |
| SA... | F.....AEG.LK.M.H.L | ..DGE....DF....... | ...... | ........... | ........... | 0.08 | 10 |

TABLE 5-continued

AAV capsid proteins having increased specificity for and/or transduction of CD44+/133+ GSC (pool of Round 1 selection). Amino acid numbers correspond to the amino acid sequence of VP1 (SEQ ID NO: 1). Sequences below correspond to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| EA... | .................. | .K.TG....DF....... | R...DR | .STREGD....N | A..A........ | 0.08 | 10 |
| SA... | F................. | .V.......F....... | ...... | ............ | GRRDP..DTI.P | 0.07 | 9 |
| ..... | .................. | ..YNR....NF....... | ...D.. | E.AGAND.AY.N | A..A........ | 0.07 | 9 |
| AA..T | F.....DKG.SH.T.K.V | .................. | ...... | ............ | A..A........ | 0.07 | 9 |
| E.... | .................. | ..HG.....NF......T | E..DD. | ............ | A..A........ | 0.07 | 9 |
| ..... | F................. | ..HG.....NF......T | ...A. | ............ | A..A........ | 0.07 | 9 |
| ..... | .................. | .V.......F....... | ...... | ............ | NP.NA..FRI.T | 0.07 | 9 |
| T.... | F.....G.G.HA.T.G.R | .........DF....... | ...... | .S.KA..TE.DS | A..A........ | 0.07 | 9 |
| ..... | F................. | .V.......F....... | ...... | ............ | GT.TS..DQ..T | 0.07 | 9 |
| NA..T | F.....GRG.H..P.E.R | .........F....... | ...... | .SASRND.AVGE | A..A........ | 0.07 | 9 |
| ..... | .................. | .................. | ...DDR | E..G.SDAA.GD | A..A........ | 0.07 | 9 |
| ..... | .................. | .................. | ...NGR | ............ | A..A........ | 0.07 | 9 |
| TT... | .................. | TQ.TG....DF....... | ...DDR | ............ | A..A........ | 0.07 | 9 |
| A...T | F......KT.NV.K...S | .................. | ...... | ............ | A..A........ | 0.07 | 9 |
| ..... | .................. | .................. | R..N.. | ..G..AD.A.DE | A..A........ | 0.07 | 9 |
| AT... | .................. | .........NF....... | R...D. | .NGST.....GG | A..A........ | 0.07 | 9 |
| ..... | .................. | .KPDQ.....F....... | R...D. | .DANRN..E.GQ | A..A........ | 0.07 | 9 |
| E.... | F.....NG..SN.M...K | ..DGE....NF....... | ...... | .N.G.N.I.V.G | A..A........ | 0.07 | 9 |
| ..... | .................. | .................. | ...DD. | .........K. | A..A........ | 0.07 | 9 |
| .A... | .................. | ..HG.....NF......T | E..DD. | ............ | ............ | 0.07 | 9 |
| ..... | .................. | .................. | R..D.. | ............ | A..A........ | 0.07 | 9 |
| ..... | .................. | .................. | ...DDR | ESAGE.DAA.DE | A..A........ | 0.07 | 9 |
| ..... | .................. | ..HG.....NF......T | E..DD. | ............ | ............ | 0.07 | 9 |
| ..... | F.....GNG.HV.H.G.R | ........DF....... | ...... | ............ | ............ | 0.07 | 9 |
| A.... | ..........A.N...R | .KYT.....NF......T | R...D. | ...G.D..EVGQ | A..A........ | 0.07 | 9 |
| .A... | F.....GKT.SL...... | .V............... | ...DDR | E.AG..D.A.DG | A..A........ | 0.07 | 9 |
| ..... | F................. | .V.......F....... | ...... | ............ | EPHAG..DNT.H | 0.07 | 9 |
| ..... | F................. | .V.......F....... | ...... | ............ | DKQGT..FRA.. | 0.07 | 9 |
| G.... | F.....SGG.RV.P...G | .QPTG....NF....... | ...... | ............ | ............ | 0.07 | 9 |
| AT..T | F.....NR..SP.T.N.G | .Q.G.....F....... | G..N.. | ............ | A..A........ | 0.07 | 9 |
| SA..T | ......AHT.LK.N...G | T.P......DF....... | ....GR | .DAGA.D.AV.E | A..A........ | 0.07 | 9 |
| ..... | .................. | .................. | ...... | ENGKAGD...GN | A..A........ | 0.07 | 9 |
| RA... | F.....AEG.LK.M.H.L | ..DGE....DF....... | ...... | ............ | ............ | 0.07 | 9 |
| ..... | F................. | .V.......F....... | ...... | ............ | KDRTH..FDM.. | 0.07 | 9 |
| ..... | .................. | .................. | R..ND. | E.TGT.DAAVDD | A..A........ | 0.07 | 9 |
| AA... | F.....AGA.SL.....R | .QP.G.....F....... | R...D. | ...AAS.A.VGQ | A..A........ | 0.07 | 9 |

TABLE 5-continued

AAV capsid proteins having increased specificity for and/or transduction of
CD44⁺/133⁺ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | ................. | ...AGR | .NA.RA.T..G. | A..A........ | 0.07 | 9 |
| ..... | ................. | ................. | ...A.. | ..GG.N.I..DR | A..A........ | 0.07 | 9 |
| ..... | ................. | ................. | R..AD. | ........... | A..A........ | 0.07 | 9 |
| GT... | F.....DQ..R..P.S.R | .QD.E.....F..P.... | ...... | E.GKGSD...GG | ........... | 0.07 | 9 |
| .A... | F......GT.NM.L.Q.G | .Q.S......F...... | ....D. | ........... | ........... | 0.07 | 9 |
| A.... | ................. | .........NF....... | R...D. | ..AK.ADT..GN | A..A........ | 0.07 | 9 |
| T.... | ................. | ..AGR....DF......T | R..D.. | E..RRD.AA..H | A..A........ | 0.07 | 9 |
| ..... | F.....AGA.NK.L...K | TQ.TG....DF....... | ...DDR | ........... | A..A........ | 0.07 | 9 |
| ..... | ................. | ................. | ...A.. | E.AS.N.IA..E | A..A........ | 0.07 | 9 |
| R.... | ................. | ..HG.....NF......T | ...A.. | ........... | A..A........ | 0.07 | 9 |
| ..... | ................. | ................. | ...D.. | E.ASTSD.AFDS | A..A........ | 0.07 | 9 |
| SA... | ................. | .........NF....... | ...TG. | E.AGGS..AVDG | A..A........ | 0.07 | 9 |
| ..... | ................. | ................. | ...D.R | ........... | ........... | 0.06 | 8 |
| DT... | F.....ARG.LV.N.Q.S | .........NF......T | R..D.R | E.AA.A....GD | A..A........ | 0.06 | 8 |
| RT... | F.....SGT.SQ.K.D.. | ..PN.....NF....... | ...NDR | ........... | A..A........ | 0.06 | 8 |
| ..... | F............... | .V.......F....... | ...... | ........... | NSRAT..S.G.H | 0.06 | 8 |
| ..... | ................. | .........F......T | ...DDR | ENTSENDIE.DR | A..A........ | 0.06 | 8 |
| ..... | ................. | ................. | R..TGR | ........... | A..A........ | 0.06 | 8 |
| .A... | F.........A.M.K.H | .QPG.....NF....... | ...DDR | E.ANG...E.G. | A..A........ | 0.06 | 8 |
| ..... | F............... | .V.......F....... | ...... | ........... | NHKGG....V.T | 0.06 | 8 |
| ..... | F.....NGG.NI.K.E.R | ..DGE....DF....... | ...... | ESTDGG..A.DS | A..A........ | 0.06 | 8 |
| ..... | ................. | ................. | ...... | .D.RTSDA.F.S | A..A........ | 0.06 | 8 |
| NA..T | ................. | ..YN......F......T | ...D.R | ........... | A..A........ | 0.06 | 8 |
| ..... | F.....ST..SV.K.H.M | TQ.TG....DF....... | ...DDR | E..AAS....GG | A..A........ | 0.06 | 8 |
| TA... | ................. | ................. | R..D.. | ........... | A..A........ | 0.06 | 8 |
| ..... | ................. | ................. | ...DDR | ..TTGA.I.FDG | A..A........ | 0.06 | 8 |
| D...T | F......GT.NM.L.Q.G | .........NF......T | ....D. | .SASEN....GR | A..A........ | 0.06 | 8 |
| ..... | ................. | .V.......F....... | ...... | ........... | G.RSG..FTG.. | 0.06 | 8 |
| ..... | ................. | .........F......T | R..DD. | ESGG.S.AA.GQ | A..A........ | 0.06 | 8 |
| ..... | ......GTG.P....K.. | ...NG.....F....... | R..DD. | E.AG...IAVDR | A..A........ | 0.06 | 8 |
| ..... | ................. | ................. | ....GR | .NA.AN..A.GE | A..A........ | 0.06 | 8 |
| ..... | F............... | .V.......F....... | ...... | ........... | SQRDK..FES.T | 0.06 | 8 |
| G.... | F.....G.G.RA.N.E.R | .KYT.....NF......T | ...DD. | ........... | A..A........ | 0.06 | 8 |
| TA... | ................. | .QANH....DF....... | ...DDR | ........... | ........... | 0.06 | 8 |
| .A... | F.....GNG.HV.H.G.R | .KDDG....NF......T | G..NG. | E.AAAN..E.DG | A..A........ | 0.06 | 8 |
| ..... | F............... | .V.......F....... | ...... | ........... | E.KTK..SSM.D | 0.06 | 8 |

TABLE 5-continued

AAV capsid proteins having increased specificity for and/or transduction of
CD44+/133+ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................. | .KYT.....NF......T | ...DDR | ........... | ........... | 0.06 | 8 |
| ..... | F.....NNG.LN.I.G.R | TQ.TG....DF....... | ...DDR | ES.SGNDIE.DQ | A..A........ | 0.06 | 8 |
| AT..T | F.....ARA.L..L.Q.G | .Q.DR.....F....... | ....D. | ........... | A..A........ | 0.06 | 8 |
| ..... | F................. | .V.......F....... | ...... | ........... | KA.TA..NST.T | 0.06 | 8 |
| TA... | F.....NS..HP.H.G.K | T.P......DF....... | ...D.. | ..NG.RGD..DG | A..A........ | 0.06 | 8 |
| AT... | .......GT.NM.L.Q.G | .Q.S......F....... | ....D. | ........... | ........... | 0.06 | 8 |
| ET... | F.....DAG.PN.L...H | T.P......DF....... | ...D.. | ........... | ........... | 0.06 | 8 |
| EA... | ................. | ................. | ....D. | ..ASE...E.D. | A..A........ | 0.06 | 8 |
| ..... | F.....DRG.N..I.A.K | .KYT.....NF......T | R..D.. | ........... | A..A........ | 0.06 | 8 |
| ..... | ................. | ..P.G............ | R...D. | ...NG....VDG | A..A........ | 0.06 | 8 |
| H.... | F................. | ................. | ...DDR | E.......... | A..A........ | 0.06 | 8 |
| ..... | ................. | ................. | R...G. | E.AR...I..DE | A..A........ | 0.06 | 8 |
| ..... | ................. | ..DGE....DF....... | ...... | .NG..G.I...G | A..A........ | 0.06 | 8 |
| GA... | F.....NG..IQ.M.N.R | ..A......DF....... | ...DG. | E.GR.DD.E.GE | A..A........ | 0.06 | 8 |
| .A... | F.......G.PE.T.G.R | ................. | G..AD. | ...G.SDI.FDE | A..A........ | 0.06 | 8 |
| ..... | ................. | ..YN......F......T | ...... | EDANG...EVDR | A..A........ | 0.06 | 8 |
| G.... | F.....SA..RA....F | ..HNH.....F......T | ...DD. | ESGTAND...DR | A..A........ | 0.06 | 8 |
| EA... | F.......G.N..T.P.L | TQ.TG....DF....... | ...DDR | ........... | A..A........ | 0.06 | 8 |
| ..... | ................. | .............P.... | E..KG. | ........... | ........... | 0.06 | 8 |
| ..... | ................. | ................. | ...AGR | ........... | A..A........ | 0.06 | 8 |
| ..... | ................. | ................. | R..ND. | ..ATRN.A.FDR | A..A........ | 0.06 | 8 |
| TA..T | F.....DE.....N...G | .QD.E....DF......T | ...... | .D..GA..EVGD | A..A........ | 0.06 | 8 |
| ..... | ................. | .V.......F....... | ...... | .N.G.G..A.DR | A..A........ | 0.06 | 8 |
| ..... | ................. | ................. | R..AD. | .SAS.N.IA..E | A..A........ | 0.06 | 8 |
| .A... | F......GT.NM.L.Q.G | ................. | ....D. | ........... | ........... | 0.06 | 8 |
| RA... | ................. | TQPTH....NF........ | R..DD. | ........... | A..A........ | 0.05 | 7 |
| NA..T | ................. | .........DF....... | ...AD. | ........... | A..A........ | 0.05 | 7 |
| ..... | ................. | ................. | ...D.. | ........... | TQKSE..FRT.H | 0.05 | 7 |
| ..... | ................. | TQYDR....NF....... | ...DDR | E..G.SDAA.GD | A..A........ | 0.05 | 7 |
| ..... | ................. | .........DF....... | ...AG. | .S.RGN...... | A..A........ | 0.05 | 7 |
| EA... | F.....DTG.SK.T.T.R | .Q.S......F....... | ...D.. | .NGR.G..A..E | A..A........ | 0.05 | 7 |
| S.... | F......KT.NV.K.T.H | T.P......DF....... | ...D.. | EDAA...AAVDQ | A..A........ | 0.05 | 7 |
| ..... | ................. | ................. | E..N.. | ..TK...AE..D | ........... | 0.05 | 7 |
| AT... | F.....ATA.RN.T.A.G | ................. | ...... | ........... | A..A........ | 0.05 | 7 |
| ..... | F.....DRG.S...T.A.A | ..DGE....DF....... | ...... | ........... | ........... | 0.05 | 7 |
| GT... | F.....SK..PA.K.A.G | .Q.DR.....F....... | ....D. | ........... | A..A........ | 0.05 | 7 |

TABLE 5-continued

AAV capsid proteins having increased specificity for and/or transduction of
CD44⁺/133⁺ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| NT..T | F.....DTG.SK.T.T.R | .QPTG.....F....... | ...NGR | ........... | A..A........ | 0.05 | 7 |
| ..... | F................. | .V.......F....... | ...... | ..SGGES.....R | ETKTR..Y.A.. | 0.05 | 7 |
| A.... | ................. | ................. | ...... | ESATRG.....R | A..A........ | 0.05 | 7 |
| ..... | F.....G.G.NQ.I.K.N | ..DGE....DF....... | ...... | ........... | A..A........ | 0.05 | 7 |
| ..... | F.....DAG.SA...... | ................. | ...N.. | E..G.SD.AYDE | A..A........ | 0.05 | 7 |
| HA... | F.....DRA.PK...P.R | ................T | ...... | ...A.SD.A.DE | A..A........ | 0.05 | 7 |
| ..... | ................. | ................. | ....GR | ........... | ........... | 0.05 | 7 |
| ..... | F................. | .V.......F....... | ...... | ........... | G..AG..VKG.Q | 0.05 | 7 |
| ..... | ................. | ................. | ...K.. | .SADGSD...DR | A..A........ | 0.05 | 7 |
| ..... | F................. | ................. | ...... | .D......... | A..A........ | 0.05 | 7 |
| ..... | F................. | .V.......F....... | ...... | ........... | DARGT..SDG.A | 0.05 | 7 |
| ..... | F.....SG..IK.K.D.R | .Q.S.....F....... | E..ND. | ...R.G.....E | A..A........ | 0.05 | 7 |
| ..... | ................. | ..AGR.....F......T | G..ND. | ........... | A..A........ | 0.05 | 7 |
| ..... | ................. | .......DF....... | ...... | ..AGRNDIA.GQ | A..A........ | 0.05 | 7 |
| ..... | ................. | .......NF....... | ...DG. | ED.GG...E.GR | A..A........ | 0.05 | 7 |
| ..... | ................. | .K.TG....DF....... | R...DR | ........... | A..A........ | 0.05 | 7 |
| GT... | F.....DRT.H..I.K.R | .V.......F....... | ...... | ........... | A..A........ | 0.05 | 7 |
| G.... | F.....SN..I..L.G.G | .Q.GQ....DF....... | ....G. | ........... | A..A........ | 0.05 | 7 |
| ..... | F................. | .V.......F....... | ...... | .N.ARSDI...G | A..A........ | 0.05 | 7 |
| G...T | ................. | .Q.GQ....DF....... | ....G. | EDAGRN...V.N | A..A........ | 0.05 | 7 |
| ..... | ................. | ................. | ...DG. | ........... | GTRDG..VN..T | 0.05 | 7 |
| AT... | F.......G.N..T.P.L | ..DGE....DF....... | ...... | ...A.SD.EVGG | ........... | 0.05 | 7 |
| DA... | F.......G.N..T.P.L | .......NF....... | R...D. | ........... | A..A........ | 0.05 | 7 |
| ..... | F.....GRT..L.H.E.S | .Q.NE....DF...... | ...ND. | ........... | A..A........ | 0.05 | 7 |
| GA... | F.....ST..SV.K.H.M | TQTPE....DF....... | G..ND. | ........... | ........... | 0.05 | 7 |
| DA... | F......AT..D.H.G.L | .K.DQ....DF....... | E..NDR | ........... | A..A........ | 0.05 | 7 |
| ..... | F.....SGT.SQ.K.... | .KYT.....NF......T | ...ND. | ........... | A..A........ | 0.05 | 7 |
| ..... | ................. | ................. | R..AGR | E.T..S..A..R | A..A........ | 0.05 | 7 |
| ..... | ................. | ................T | ...D.. | ESGGES...V.H | A..A........ | 0.05 | 7 |
| ..... | ................. | .QP.G.....F....... | R...D. | E.ANGA.IE.GD | A..A........ | 0.05 | 7 |
| ..... | ................. | ................. | E..ND. | ........... | ........... | 0.05 | 7 |
| ..... | ................. | TQP.R....NF......T | ...D.. | ........... | A..A........ | 0.05 | 7 |
| ..... | F.....NS..RI.T.N.R | .HG......F......T | ...DDR | .DTAG.D.A.DG | A..A........ | 0.05 | 7 |
| D...T | F......GG.NA.H.Q.R | ................. | ....GR | ..ATAN.TEF.H | A..A........ | 0.05 | 7 |
| AA... | ................. | ................. | ....D. | E.AGAND.AY.N | ........... | 0.05 | 7 |
| HA... | F.....ANG.HL.K.K.S | T.PTG....DF....... | ...DDR | .SAS.N.IA..E | A..A........ | 0.05 | 7 |

TABLE 5-continued

AAV capsid proteins having increased specificity for and/or transduction of
CD44⁺/133⁺ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | ................ | ................ | ....D. | ESAGAN.....E | A..A........ | 0.05 | 7 |
| D.... | F.....SRA.SK.N.A.H | ................ | ...... | ........... | A..A........ | 0.05 | 7 |
| ..... | ................ | ................ | R..AGR | .SAKAA.AA.DE | A..A........ | 0.05 | 7 |
| ..... | F............... | .V.......F....... | ...... | ........... | AQRT...YGT.. | 0.05 | 7 |
| ..... | ................ | .KYT.....NF......T | ....G. | ...AGS.IAFDG | A..A........ | 0.05 | 7 |
| ..... | F............... | .V.......F....... | ...... | ........... | ASRTG..FQG.H | 0.05 | 7 |
| SA... | F.....SN..PL.K.T.. | .Q.DR....NF....... | E..N.. | ........... | A..A........ | 0.05 | 7 |
| ..... | ................ | ................ | R..DD. | EN.KAN....GG | A..A........ | 0.05 | 7 |
| ..... | F............... | .V.......F....... | ...... | ........... | SASTT..VTE.K | 0.05 | 6 |
| G.... | F.....DS..NH.I.P.R | ..PNG....DF....... | ....DR | ESAREN.AE.DE | A..A........ | 0.05 | 6 |
| ..... | F.....DAA.IK.T.Q.N | ..DGE....DF....... | ...... | E.......... | ............ | 0.05 | 6 |
| AA... | ................ | TYQT.....NF......T | ...DDR | E.T..S..A..R | A..A........ | 0.05 | 6 |
| ..... | F............... | .V.......F....... | ...... | ........... | GHRTP..IDG.A | 0.05 | 6 |
| ..... | ......G.T.II.P.D.R | .........NF....... | R...D. | ........... | A..A........ | 0.05 | 6 |
| NA... | F.....SA..RA.....R | .V.......F....... | ...... | .SAN..DA..DN | A..A........ | 0.05 | 6 |
| TA..T | ................ | ................ | ....D. | .DTAA...EF.G | A..A........ | 0.05 | 6 |
| DT... | F.....D...S..M.T.R | TQ.TG....DF....... | ...DDR | ES.SGNDIE.DQ | A..A........ | 0.05 | 6 |
| ..... | F.....ATG.NN.I.S.G | .KDSR....DF....... | ...DDR | ........... | A..A........ | 0.05 | 6 |
| ..... | F............... | ................ | ...... | ........... | GRRDP..DTI.P | 0.05 | 6 |
| ..... | .............H.S.V | ..YN......F......T | ...D.R | ........... | ............ | 0.05 | 6 |
| NA... | F......Q..IE....R | ..P.E....NF......T | E..NDR | .NAGRDD.A..E | A..A........ | 0.05 | 6 |
| ..... | ................ | ................ | ...... | E.AG.S...... | A..A........ | 0.05 | 6 |
| EA... | ................ | .V.......F....... | ...... | .N.G.G..A.DR | A..A........ | 0.05 | 6 |
| GA... | ................ | ..PNG....DF...... | G..NDR | ES.GGD.I.VDE | A..A........ | 0.05 | 6 |
| EA... | F.....DAA.IK.T.Q.N | ..DGE....DF....... | ...... | E.......... | ............ | 0.05 | 6 |
| ..... | ................ | ..HG.....NF......T | ...A.. | ........... | A..A........ | 0.05 | 6 |
| G.... | F.....SG..IK.K.D.R | T.P......DF....... | G..K.. | ........... | A..A........ | 0.05 | 6 |
| ..... | ................ | .........NF....... | ...DDR | ESAGTSD..FDR | A..A........ | 0.05 | 6 |
| ..... | ................ | ....E....DF....... | T..AGR | E.ATA.DTAV.D | A..A........ | 0.05 | 6 |
| ..... | ................ | TQ.TG....DF....... | ...DDR | E.GD.SD..V.H | A..A........ | 0.05 | 6 |
| ..... | ................ | ................ | E..KG. | ........... | ............ | 0.05 | 6 |
| AA... | ................ | ................ | ....D. | E.AGAND.AY.N | A..A........ | 0.05 | 6 |
| ..... | ................ | ................ | E..AD. | ........... | A..A........ | 0.05 | 6 |
| ..... | ................ | ................ | R...D. | E.AR.S..EVGE | A..A........ | 0.05 | 6 |
| ..... | ................ | ................ | R...D. | EDGK.A..EVGQ | A..A........ | 0.05 | 6 |
| R...T | ................ | T.P......DF....... | R..AD. | ENGKT.D.AFDQ | A..A........ | 0.05 | 6 |

TABLE 5-continued

AAV capsid proteins having increased specificity for and/or transduction of
CD44+/133+ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F.....AS..LE.M.T.R | ..DGE....DF....... | R..ND. | EDAGGSDA.V.Q | A..A........ | 0.05 | 6 |
| ..... | .................. | .Q.......DF....... | ...DDR | ............ | A..A........ | 0.05 | 6 |
| SA... | F.....SN...P.H.T.K | TQPNH....DF....... | ...... | EN.G.A.....Q | A..A........ | 0.05 | 6 |
| DA... | F.....DR..LE.K...R | ..DGE....DF....... | ...... | ............ | A..A........ | 0.05 | 6 |
| ..... | .......GT.NM.L.Q.G | .Q.S......F....... | ....D. | ............ | ............ | 0.05 | 6 |
| R.... | .................. | TKDDR....DF....... | ...DDR | ............ | A..A........ | 0.05 | 6 |
| ..... | .................. | .................. | ...D.R | ES.DGN..A.DG | A..A........ | 0.05 | 6 |
| ..... | .................. | T.P......DF....... | ...D.. | .NTSTSD.E.DG | ............ | 0.05 | 6 |
| NT... | F.....ARG.HP.P.T.E | .........DF....... | R..D.. | ............ | A..A........ | 0.05 | 6 |
| G.... | F................. | .V.......F....... | ...... | ............ | GARGG...K..Q | 0.05 | 6 |
| ..... | .................. | .................. | R...D. | E.AG..D.A.GR | A..A........ | 0.05 | 6 |
| ..... | .................. | .................. | R..TG. | ............ | GR.DP..FNN.D | 0.05 | 6 |
| TT... | F.....SNG.RE.L...K | .................. | ...... | ............ | A..A........ | 0.05 | 6 |
| D.... | .................. | .................. | ...N.. | ............ | A..A........ | 0.05 | 6 |
| ..... | .................. | .................. | ...D.R | ...RRND...DR | A..A........ | 0.05 | 6 |
| ..... | F................. | .V.......F....... | ...... | ............ | GPRNA..NSV.D | 0.05 | 6 |
| .T... | F.....GT..I..N.T.G | .KYT.....NF......T | ...... | ............ | A..A........ | 0.05 | 6 |
| TA..T | F......KT.NV.K.T.H | .QPG.....DF......T | ...DG. | ..A.A.D.AFDI | A..A........ | 0.05 | 6 |
| ..... | .........NV...T... | ..PDH....DF....... | ....GR | .DTGAS..A.DR | A..A........ | 0.05 | 6 |
| N.... | .................. | .Q.GQ....DF....... | ....G. | .D.TTA....D. | A..A........ | 0.05 | 6 |
| G.... | .................. | .QPN......F......T | ...N.. | EDTTGA.A..GQ | A..A........ | 0.04 | 5 |
| D...T | F.....AGA.HK.N.G.G | .........NF....... | R...D. | ............ | A..A........ | 0.04 | 5 |
| TA..T | F.....SGA..N...G.R | .Q.S......F....... | E..AD. | E.ATEGD.A... | A..A........ | 0.04 | 5 |
| ..... | .................. | .................. | ...D.R | ENAAEG.I..DR | A..A........ | 0.04 | 5 |
| ..... | .................. | .................. | ...DDR | .SA.GG....DG | A..A........ | 0.04 | 5 |
| N.... | F......GG.NA.I...R | ..YN......F....... | ...... | ............ | GPKGR..DQN.. | 0.04 | 5 |
| EA..T | F.....S.A.N..L...L | .V.......F....... | ...N.. | .SASE.D...DS | A..A........ | 0.04 | 5 |
| DT..T | F......G..NQ.N.D.K | ..YN......F......T | ...D.R | ............ | ............ | 0.04 | 5 |
| ..... | .................. | .................. | ...DD. | ES.A.S..A.D. | A..A........ | 0.04 | 5 |
| R.... | .................. | .Q.DH....NF....... | ...DD. | .SGREGDAE..D | A..A........ | 0.04 | 5 |
| RA... | F.....SK..PA.K.A.G | .Q.DR......F....... | ....D. | ............ | A..A........ | 0.04 | 5 |
| S.... | F.....DTG.PA.L.T.K | ..AGR....DF......T | ....GR | E.AG.SDIA.DG | A..A........ | 0.04 | 5 |
| ..... | .................. | .Q.S......F....... | E..N.. | .DAGGS..EFGG | A..A........ | 0.04 | 5 |
| A...T | F.......T.SV...H.R | T.DNG....DF....... | ...DDR | ...G.S..AFGD | A..A........ | 0.04 | 5 |
| ..... | F.....SK.PA.K.A.G | .Q.DR......F....... | ....D. | ............ | A..A........ | 0.04 | 5 |
| AT... | .................. | .................. | E..TGR | ............ | A..A........ | 0.04 | 5 |

TABLE 5-continued

AAV capsid proteins having increased specificity for and/or transduction of
CD44$^+$/133$^+$ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | F.....ATT..N.L...L | .QPN......F......T | ...DDR | ............ | A..A........ | 0.04 | 5 |
| ..... | ................. | ................. | E..KDR | ............ | ............ | 0.04 | 5 |
| ..... | ................. | ................. | R..N.. | E..K.G..E.DQ | A..A........ | 0.04 | 5 |
| ..... | F.....NGT.IL.T.A.K | T.P......DF....... | ...D.. | ............ | A..A........ | 0.04 | 5 |
| GT... | F................. | ..HG......F...... | ...... | ............ | DRRTT..FT..P | 0.04 | 5 |
| G.... | F.....NGG.NN.K.T.R | .QPG.....NF....... | ...DDR | ..GA.A...V.H | A..A........ | 0.04 | 5 |
| EA... | ................. | ................. | R..AG. | ............ | A..A........ | 0.04 | 5 |
| ..... | ................. | .........NF....... | E...G. | ............ | A..A........ | 0.04 | 5 |
| EA... | F.....ATT.HA.T.T.L | .Q.......DF....... | ...AD. | E.AA.SD.AVGG | A..A........ | 0.04 | 5 |
| SA... | ................. | TK.NE....DF......T | ...D.R | .NAAAN.A.Y.S | A..A........ | 0.04 | 5 |
| TA..T | F......K.....L.G.L | T.AG.....DF....... | ...D.. | ............ | A..A........ | 0.04 | 5 |
| RA... | F................. | .QATR.....F....... | E..DG. | ............ | A..A........ | 0.04 | 5 |
| TT..T | F.....SGG.SH...A.R | ..P.E....NF.....T | R...D. | ............ | A..A........ | 0.04 | 5 |
| ..... | ................. | ................. | R..... | ..TG.A.I..D. | A..A........ | 0.04 | 5 |
| ..... | F................. | ................. | R..AD. | ............ | A..A........ | 0.04 | 5 |
| ..... | ................. | ................. | ...D.. | ...G.D..EVGQ | A..A........ | 0.04 | 5 |
| ..... | F.....G.G.IN.L...V | .........NF....... | ...DDR | ............ | A..A........ | 0.04 | 5 |
| GA..T | F.....STG.LQ.L.D.R | ................. | ...... | ..TGGSDAA.DG | A..A........ | 0.04 | 5 |
| ..... | ................. | TQDS.....NF....... | ...A.. | ............ | A..A........ | 0.04 | 5 |
| D...T | F.....NRT.NM.T.P.G | ..PDG....NF....... | ....DR | .NAT.A.A.FGD | A..A........ | 0.04 | 5 |
| A.... | F................. | ..DGE....DF....... | E..DD. | ............ | A..A........ | 0.04 | 5 |
| RA... | F......AG.RA.....V | ..DGE....DF....... | ...... | ............ | A..A........ | 0.04 | 5 |
| DA... | F.....ST..SV.K.H.M | TQ.TG....DF....... | ...DDR | E..AAS....GG | A..A........ | 0.04 | 5 |
| ..... | ................. | ..HG......F...... | ...... | ............ | GTRGG...K..D | 0.04 | 5 |
| ..... | F.....ARG.SK.L.A.L | .QPN......F......T | ...N.. | ............ | A..A........ | 0.04 | 5 |
| ..... | ................. | ................. | G..DD. | EDAG.AD.E..R | ............ | 0.04 | 5 |
| ..... | F................. | .V.......F....... | ...... | ............ | G.SGN..FQT.. | 0.04 | 5 |
| ..... | F................. | .V.......F....... | ...... | ............ | KKHS...D.M.. | 0.04 | 5 |
| ..... | F................. | .V.......F....... | ...... | ............ | S.RAG..VSE.K | 0.04 | 5 |
| ..... | ................. | ................. | ...D.R | ..ADGN..AFGE | A..A........ | 0.04 | 5 |
| TT..T | ................. | .QAS.....NF......T | E...G. | ..ARGADAE..S | A..A........ | 0.04 | 5 |
| ..... | ................. | ................. | E..AD. | ENASG.....GN | A..A........ | 0.04 | 5 |
| ..... | ................. | ................. | E..KD. | ............ | ............ | 0.04 | 5 |
| ..... | ................. | .V.......F....... | ...... | ............ | TARSA..VDG.A | 0.04 | 5 |
| N.... | ................. | .Q.GQ....DF....... | ...NGR | .DADGND.A.DQ | A..A........ | 0.04 | 5 |
| A.... | ................. | .QDNE....DF......T | ...N.. | .NATG....VGS | A..A........ | 0.04 | 5 |

TABLE 5-continued

AAV capsid proteins having increased specificity for and/or transduction of
CD44+/133+ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| H.... | .................. | ..DGE....DF....... | R...D. | ............ | ............ | 0.04 | 5 |
| RA... | F.....SG..RV.I.G.R | ..DGE....DF....... | .....R | EN.G.SD.A.D. | A..A........ | 0.04 | 5 |
| ..... | .................. | .................. | ....DR | ESGTTA...VGQ | A..A........ | 0.04 | 5 |
| ..... | .................. | .................. | E..NGR | ............ | A..A........ | 0.04 | 5 |
| ..... | .................. | .................. | ...... | ENTN.D.....R | A..A........ | 0.04 | 5 |
| ..... | .................. | .................. | ....D. | ...R.G.....E | A..A........ | 0.04 | 5 |
| ..... | .................. | ..........F....... | R...D. | ............ | .PKAP..DTT.. | 0.04 | 5 |
| ..... | .................. | .................. | ....D. | ES.TTG..A..G | A..A........ | 0.03 | 4 |
| H.... | F................. | .................. | ...DDR | ............ | A..A........ | 0.03 | 4 |
| ..... | .................. | .KYT.....NF......T | ...... | E.GG.....FD. | A..A........ | 0.03 | 4 |
| E...T | ............K.S.S | .QPNQ....NF....... | R...D. | ES.GAN..EVDG | A..A........ | 0.03 | 4 |
| D.... | .................. | .................. | ...DDR | .STAAG...VDG | A..A........ | 0.03 | 4 |
| ..... | .................. | .QPSQ....NF....... | ...DDR | E.AG...IAVDR | A..A........ | 0.03 | 4 |
| ..... | .................. | .................. | ...DDR | E.GR.G.A..DE | A..A........ | 0.03 | 4 |
| ..... | ......NQG....P.K.I | .Q.DR.....F....... | ...DDR | E..N...I..DR | A..A........ | 0.03 | 4 |
| SA... | F.....NR..N..I.T.G | .Q.DR.....F....... | ....D. | ............ | A..A........ | 0.03 | 4 |
| D...T | F.....DAA.IK.T.Q.N | ..DGE....DF....... | ...... | E........... | ............ | 0.03 | 4 |
| ..... | .................. | .................. | ...D.R | .N.AE...E.DG | A..A........ | 0.03 | 4 |
| .A... | F.....ANG.HL.K.K.S | T.PTG....DF....... | ...DDR | .SAS.N.IA..E | A..A........ | 0.03 | 4 |
| ..... | F................. | .V.......F........ | ...... | ............ | .R.SA..FSG.D | 0.03 | 4 |
| ..... | .................. | .QPGQ....NF....... | E..AD. | .SASEN.I..DR | A..A........ | 0.03 | 4 |
| G.... | F.....GHA.SK.T.E.K | .QPSQ....NF....... | R...D. | ............ | A..A........ | 0.03 | 4 |
| R.... | .................. | ..AGR....DF......T | ....D. | ............ | A..A........ | 0.03 | 4 |
| ..... | .................. | .................. | E..ND. | ESGRANDA...S | A..A........ | 0.03 | 4 |
| G.... | F.....GTT.NI.I.K.R | .................. | ...... | ............ | A..A........ | 0.03 | 4 |
| ..... | .................. | ..YN......F......T | ...D.R | .S.TRG.AAVDE | A..A........ | 0.03 | 4 |
| D.... | F.....SRA.SK.N.A.H | .Q.GQ....DF....... | ....G. | ............ | A..A........ | 0.03 | 4 |
| ..... | .................. | .................. | R..DD. | EDAA.SDAAY.E | A..A........ | 0.03 | 4 |
| ....T | ...............G.. | .........DF....... | ...DDR | ............ | A..A........ | 0.03 | 4 |
| SA... | F.....SA..RA.....R | .Q.G......F....... | ...... | ENATGGDAE.DQ | A..A........ | 0.03 | 4 |
| ..... | .................. | .................. | ...DDR | .STAES.I..DG | A..A........ | 0.03 | 4 |
| G.... | .................. | .KYT.....NF......T | ...ND. | ED.R.S.A...G | A..A........ | 0.03 | 4 |
| ..... | .................. | .Q.D.....DF..P.... | ...ND. | ............ | A..A........ | 0.03 | 4 |
| TT... | F.....NAT.RD.M.T.K | ..HG.....NF......T | ....G. | ............ | A..A........ | 0.03 | 4 |
| R.... | F.....SG..IK.K.D.R | .................. | ...... | ..GTGDD.A.D. | A..A........ | 0.03 | 4 |
| TA... | .................. | TQYDR....NF....... | ...DDR | E..G.SDAA.GD | A..A........ | 0.03 | 4 |

TABLE 5-continued

AAV capsid proteins having increased specificity for and/or transduction of
CD44⁺/133⁺ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| ..... | .................. | .................. | R..N.. | ..AKAND...GS | A..A........ | 0.03 | 4 |
| DA... | F.....ASA.S..T.T.G | .QPG.....DF....... | ...DDR | ........... | ............ | 0.03 | 4 |
| ..... | F.....GTT.PM.M.A.R | .V........F....... | ...... | ........... | ANKDP..FKE.. | 0.03 | 4 |
| ..... | .................. | .................. | R..DG. | ........... | A..A........ | 0.03 | 4 |
| ..... | .................. | ........DF..P.... | ...AD. | ........... | A..A........ | 0.03 | 4 |
| DT... | .................. | ..........NF....... | ...DDR | ESGRR...E..Q | A..A........ | 0.03 | 4 |
| ..... | .................. | .................. | ...DDR | .NG.EG....GR | A..A........ | 0.03 | 4 |
| ..... | .................. | .................. | R..TG. | ..TK...AE..D | A..A........ | 0.03 | 4 |
| ..... | .................. | .KYT.....NF......T | R..D.. | .SAKAA.AA.DE | A..A........ | 0.03 | 4 |
| R.... | .................. | .................. | E..N.. | ........... | AV.V........ | 0.03 | 4 |
| RA... | F......TT.HN.L.G.R | T.PGG....NF....... | ...DD. | ........... | A..A........ | 0.03 | 4 |
| .A... | F.....A...HV.L.... | ..DGE....DF....... | ...... | ........... | ............ | 0.03 | 4 |
| A.... | F.....DDG.SM.L...R | .Q.S......F....... | E..AD. | ED.RGG....GG | A..A........ | 0.03 | 4 |
| ..... | F................ | .V........F....... | ...... | ........... | GTRS...AE..K | 0.03 | 4 |
| EA... | .................. | ..YN......F..P.... | ...... | .S.TRG.AAVDE | A..A........ | 0.03 | 4 |
| ..... | .................. | .................. | ...D.. | .NATAG...FD. | A..A........ | 0.03 | 4 |
| ..... | .................. | .................. | ...DDR | .NASG..A.VGQ | A..A........ | 0.03 | 4 |
| .A... | ..............K.K | .QHNQ.....F......T | ...D.. | ESTKRA.AE.GE | A..A........ | 0.03 | 4 |
| GA... | .................. | ..T............... | ...DDR | ........... | A..A........ | 0.03 | 4 |
| ..... | .................. | .................. | R..DDR | E.AGES.A.Y.Q | A..A........ | 0.03 | 4 |
| AT... | F.....AST.PI.K.Q.K | TQ.TH....DF....... | ...... | ........... | A..A........ | 0.03 | 4 |
| ..... | F................ | .V........F....... | ...... | ........... | G.KSG..N...Q | 0.03 | 4 |
| ..... | .................. | ...............NF | ...DG. | .DTTRG.A.VDQ | A..A........ | 0.03 | 4 |
| R.... | .................. | .................. | E..N.. | ........... | AV.A........ | 0.03 | 4 |
| T...T | F.....AET..A.T...K | .KAS.....NF......T | E..DD. | ........... | A..A........ | 0.03 | 4 |
| E.... | .................. | TQ.TR....NF......T | G..NDR | ........... | A..A........ | 0.03 | 4 |
| ..... | F................ | .V........F....... | ...... | ........... | G.RTG..VR..H | 0.03 | 4 |
| SA... | .................. | ..YN......F......T | ...DD. | ........... | A..A........ | 0.03 | 4 |
| ..... | F................ | .V........F....... | ...... | ........... | SKRGG..FTT.E | 0.02 | 3 |
| HT... | .................. | .V........F....... | ...... | ........... | A..A........ | 0.02 | 3 |
| ..... | .................. | .........F....... | E..ND. | ESAGAN....GG | A..A........ | 0.02 | 3 |
| ..... | F.....DN..IK.H.S.G | ..DGE....DF....... | ...DDR | ........... | A..A........ | 0.02 | 3 |
| ..... | .................. | .................. | ...D.. | ESGS.S.IA.DQ | A..A........ | 0.02 | 3 |
| ..... | F.....G.G.HA.T.G.R | TQPTE....DF....... | ...DDR | ........... | A..A........ | 0.02 | 3 |
| NA..T | F.....SGT.SQ.K.E.. | .QPSR.....F....... | ...... | ........... | A..A........ | 0.02 | 3 |
| ..... | F................ | .V........F....... | ...... | ........... | TDQSR..FTE.D | 0.02 | 3 |

TABLE 5-continued

AAV capsid proteins having increased specificity for and/or transduction of
CD44⁺/133⁺ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| GT..T | F.....STG.LQ.L.D.R | ..HNH....DF....... | ....D. | .SAKAA.AA.DE | A..A........ | 0.02 | 3 |
| ..... | F................. | ................. | E..ND. | ............ | ............ | 0.02 | 3 |
| ..... | ................. | ................. | E..AD. | ..GGA.D.E.GN | A..A........ | 0.02 | 3 |
| ..... | ................. | ................. | R..ND. | ............ | A..A........ | 0.02 | 3 |
| ..... | ................. | ................. | G..ND. | ............ | A..A........ | 0.02 | 3 |
| N.... | F.....DR..LE.K...R | TQ.GR....DF..P...T | ....D. | ............ | A..A....... | 0.02 | 3 |
| ..... | F................. | ................. | ...... | ............ | ..SNH..AKE.H | 0.02 | 3 |
| ..... | ................. | ................. | R..N.. | ...G.D..EVGQ | A..A........ | 0.02 | 3 |
| E.... | F......KT.NV.K.T.H | ...NG.....F....... | R...DR | .SGS.NDIA..D | A..A........ | 0.02 | 3 |
| .A... | F......S..SE.T...R | .V................ | ...DDR | ............ | A..A........ | 0.02 | 3 |
| ..... | ................. | ................. | R..AGR | ............ | A..A........ | 0.02 | 3 |
| EA... | ................. | ................. | R...D. | ED.R.S.A...G | ............ | 0.02 | 3 |
| ..... | ................. | ................. | ...... | ESAT.A.A..DR | A..A........ | 0.02 | 3 |
| ..... | ................. | ................. | ...N.. | E..TAA.AAFDE | A..A........ | 0.02 | 3 |
| ..... | ................. | ................. | ...... | ............ | GARGH..VR..A | 0.02 | 3 |
| ..... | ................. | ................. | E..ND. | .S.ATGDTE.DG | A..A........ | 0.02 | 3 |
| ..... | ................. | .QANH.....F......T | ...D.R | E..G.ND.EVDR | A..A........ | 0.02 | 3 |
| ..... | F................. | .V.......F....... | ...... | ............ | TPKAN..AQI.E | 0.02 | 3 |
| ..... | F................. | .V.......F.....R | ...... | ............ | ERSGA..IE..D | 0.02 | 3 |
| ..... | ................. | .QANH....DF....... | ...DDR | ............ | A..A........ | 0.02 | 3 |
| AA... | F.....STG.PI.M...R | ..DGE....DF....... | ...... | ............ | A..A........ | 0.02 | 3 |
| TA... | ................. | ................. | ....GR | ............ | A..A........ | 0.02 | 3 |
| ..... | ................. | ................. | R...D. | ESGSGSD..FDH | A..A........ | 0.02 | 3 |
| ..... | F................. | .V.......F....... | ...... | ............ | TP.SD..NDK.D | 0.02 | 3 |
| ..... | F................. | .V.......F....... | ...... | ............ | SDRAP...ST.K | 0.02 | 3 |
| ..... | ................. | .KPDQ.....F....... | R..AGR | .NAGASDA.FDQ | A..A........ | 0.02 | 3 |
| ..... | ................. | ................T | T..TG. | ESAN...I...H | A..A........ | 0.02 | 3 |
| A.... | F.....ATT.L..M...G | .V.......F....... | ...... | ED.KAN..A.D. | A..A........ | 0.02 | 3 |
| GA... | ................. | .........F.....T | ....GR | ...RGND..V.E | A..A........ | 0.02 | 3 |
| ..... | F................. | .V.......F....... | ...... | ............ | ANRDG..VRV.H | 0.02 | 3 |
| EA... | ................. | TKDDR....DF....... | R..ND. | E.TARN.AAFDE | A..A........ | 0.02 | 3 |
| NA..T | ................. | .........NF....... | E..ND. | ............ | A..A........ | 0.02 | 3 |
| R.... | F......HG.I..M.Q.R | TKDT.....NF....... | ...... | E.AG.A..EF.R | A..A........ | 0.02 | 3 |
| TA... | ................. | .........NF....... | R...D. | .NGRTGDA.V.Q | A..A........ | 0.02 | 3 |
| ..... | ................. | .........DF....... | ...DDR | ............ | A..A........ | 0.02 | 3 |
| ..... | ................. | .........NF......T | ...... | .ST..D..AV.Q | A..A........ | 0.02 | 3 |

TABLE 5-continued

AAV capsid proteins having increased specificity for and/or transduction of
CD44⁺/133⁺ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| E.... | F.....STG.LQ.L.D.R | T..NE....DF......T | R..D.R | ..TG.N.IAF.D | A..A........ | 0.02 | 3 |
| EA... | ................. | ..........F........ | ...DDR | ............ | AHSDG...TT.D | 0.02 | 3 |
| ..... | F.....AA..P..L.K.N | ...TE.....F......T | ...NGR | ............ | A..A........ | 0.02 | 3 |
| NT... | ................. | ........DF........ | R...D. | EDAA...AAVDQ | A..A........ | 0.02 | 3 |
| ..... | ................. | ................. | ...DDR | E.T..S..A..R | A..A........ | 0.02 | 3 |
| ..... | ................. | ................. | ...... | ............ | A..T........ | 0.02 | 3 |
| ..... | ................. | ........DF........ | ...... | ..AG...IAYGN | A..A........ | 0.02 | 3 |
| ..... | ................. | ................. | ...D.. | ..ATGS..EYGS | A..A........ | 0.02 | 3 |
| ..... | ................. | ........NF........ | R...D. | ............ | A..A........ | 0.02 | 3 |
| ..... | ................. | ................. | ...... | ESTK..D.A.GD | A..A........ | 0.02 | 3 |
| ..... | F................. | .V........F........ | ...... | ............ | NR.AD..VDE.. | 0.02 | 3 |
| ..... | ................. | .Q.GQ....DF........ | R..ND. | ..AK.ADT..GN | A..A........ | 0.02 | 3 |
| NT... | ................. | ..PN.....NF........ | R..AGN | ..TNE..I..DG | A..A........ | 0.02 | 3 |
| AA... | F.....ANG.HL.K.K.S | ................. | ...... | ............ | A..A........ | 0.02 | 3 |
| DA... | ................. | ................. | ...T.. | ............ | A..A........ | 0.02 | 3 |
| NA... | F.....AST.HD.T.E.R | TKAGE....NF..P...T | ...DDR | ............ | A..A........ | 0.02 | 3 |
| G.... | F.......T.HH.P.G.K | .KHDH....DF........ | ...DDR | ............ | A..A........ | 0.02 | 3 |
| G.... | F.....SSA.NV.K.G.R | ..HG.....NF......T | R..N.. | .SAGAN..E..S | A..A........ | 0.02 | 3 |
| ..... | ................. | ................. | G..DD. | .NAGGNDIA.GE | A..A........ | 0.02 | 3 |
| G.... | F.....A.A.RE.I.... | .KPDQ.....F........ | ...... | E..TGS..EYDR | A..A........ | 0.02 | 3 |
| ..... | F................. | .V........F........ | ...... | ............ | .PSAT....G.A | 0.02 | 3 |
| ..... | F.....ARG.PQ.N.G.G | ..HG.....NF......T | ...DD. | ............ | A..A........ | 0.02 | 2 |
| A.... | F.....DNT.SK.L...K | .Q.DQ.....F........ | ...DD. | .DA..ND.A..E | A..A........ | 0.02 | 2 |
| RT... | F......SG.HP.T.A.L | TQ.TG....DF........ | ...DDR | ............ | A..A........ | 0.02 | 2 |
| HT..T | F.....NGG.NV.N.K.G | .........NF........ | R...D. | .DAGAN.AEVGE | A..A........ | 0.02 | 2 |
| G.... | F.....NGG.NN.K.T.R | .QPG.....NF........ | ...DDR | .CGA.A...V.H | A..A........ | 0.02 | 2 |
| .A... | ................. | .KPDQ.....F........ | ...NDR | .SAGGSD.AFDE | A..A........ | 0.02 | 2 |
| ..... | ................. | ................. | ...A.. | ..TR.ND.A.DE | A..A........ | 0.02 | 2 |
| ..... | ................. | ................. | Q...GR | ..AG.N.AA.GQ | A..A........ | 0.02 | 2 |
| ..... | ................. | ................. | ...... | ..AKA.DTEV.Q | A..A........ | 0.02 | 2 |
| ..... | F................. | T.PNE....DF........ | R..DDR | ............ | A..A........ | 0.02 | 2 |
| ..... | ................. | TQHGH....DF........ | ...DD. | .SGREGDAE..D | A..A........ | 0.02 | 2 |
| R...T | ................. | .V........F........ | E..TD. | ............ | A..A........ | 0.02 | 2 |
| .A... | F.......G.PE.T.G.R | .KDSR....DF........ | E..NGR | ............ | A..A........ | 0.02 | 2 |
| ..... | ................. | ................. | ...DDR | .SGGRS..G.DQ | A..A........ | 0.02 | 2 |
| ..... | ................. | ................. | N...GR | ..AG.N.AA.GQ | A..A........ | 0.02 | 2 |

TABLE 5-continued

AAV capsid proteins having increased specificity for and/or transduction of
CD44⁺/133⁺ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| SA... | F.....NGT.IL.T.A.K | .QHNQ.....F......T | ...D.. | ...NG....VDG | A..A........ | 0.02 | 2 |
| R.... | F.....NGG.NI.K.E.R | ................. | ...... | .NASEN.AA..D | A..A........ | 0.02 | 2 |
| E.... | F.....DRG.S..T.A.S | ..DGE....DF...... | ...... | ........... | ........... | 0.02 | 2 |
| TA... | F.....AQ...A.L.... | .QD.E.....F..P.... | .G.... | ........... | ........... | 0.02 | 2 |
| ..... | ................. | ................. | R..DG. | ..AG.DD...GG | A..A........ | 0.02 | 2 |
| ..... | ................. | ..........NF...... | ...TG. | E.AGGS..AVDG | A..A........ | 0.02 | 2 |
| SA..T | F.....AR..L..P.D.K | .KYT.....NF......T | R...D. | E.......... | A..A........ | 0.02 | 2 |
| ..... | ............P.D.R | TQANH.....F....... | E..AGR | .DAAG.D.AFDG | A..A........ | 0.02 | 2 |
| ..... | ................. | ..........NF......T | ...DDR | ...AASDI..DR | A..A........ | 0.02 | 2 |
| ..... | ................. | ................. | ...DD. | ..TTGA..AY.D | A..A........ | 0.02 | 2 |
| .A... | F.....S.A.N..L...L | ..A......DF...... | ...DG. | ........... | A..A........ | 0.02 | 2 |
| ..... | ................. | ................. | ...... | .SAKAA.AA.DE | A..A........ | 0.02 | 2 |
| T...T | ................. | T.YNH.....F...... | ...DDR | ENAG.SD.E..H | A..A........ | 0.02 | 2 |
| E.... | F.....AG..LP.L.N.R | ................. | ...... | E.AGG.DTE..R | A..A........ | 0.02 | 2 |
| ..... | ................. | .QANH.....F......T | G..ND. | EDAG...I..GQ | A..A........ | 0.02 | 2 |
| .A... | F.....ARA.IE....L | .........NF...... | R...D. | E..G.A..A.DR | A..A........ | 0.02 | 2 |
| SA... | F.....DRG.S..T.A.S | ..DGE....DF...... | ...... | ........... | ........... | 0.02 | 2 |
| ..... | ...............I. | ................. | ...... | .NGR..DAEV.H | A..A........ | 0.02 | 2 |
| R...T | F.....DKG.HM.L.G.R | .........DF...... | ...... | ........... | A..A........ | 0.02 | 2 |
| ..... | F.....GNG.HV.H.G.R | .PPNG.....F......T | ...DDR | E.ATRA..A.DE | A..A........ | 0.02 | 2 |
| ..... | F................. | .V........F...... | ...... | ........... | TRKG...S.E.. | 0.02 | 2 |
| EA... | ................. | .Q.G......F..P.... | ...... | ES.GEG...VDS | ............ | 0.02 | 2 |
| A.... | ............H...N | ..DGE....DF...... | ...... | E.TDAND..VGQ | A..A........ | 0.02 | 2 |
| ..... | F................. | .V........F...... | ...... | ........... | KA.TR..AQ..Q | 0.02 | 2 |
| ..... | ................. | ................. | ...AG. | ........... | A..A........ | 0.02 | 2 |
| SA... | F.....NGT.IL.T.A.K | .QHNQ.....F......T | ...D.. | .D.GA.DAEVDG | A..A........ | 0.02 | 2 |
| T.... | F.....N.G.IV.....R | TQDTQ....DF...... | R...DR | ........... | A..A........ | 0.02 | 2 |
| ..... | ................. | ................. | R..TG. | ........... | A..A........ | 0.02 | 2 |
| D.... | F.....SGG.IN.H.... | .........NF...... | R...D. | ........... | A..A........ | 0.02 | 2 |
| .A..T | ................. | .........DF...... | N..AD. | ........... | A..A........ | 0.02 | 2 |
| ..... | ................. | ................. | R...D. | ED.R.S.A...G | ............ | 0.02 | 2 |
| GT..T | F.....GRG.N.....H | ...TE.....F......T | ...... | ........... | A..A........ | 0.02 | 2 |
| ..... | ..........SP.H.E.V | ..HG.....NF......T | ...NDR | E.AGAND.AV.H | A..A........ | 0.02 | 2 |
| DT... | F.....NKT.HL.T.A.R | ..YN......F......T | ...D.R | ........... | A..A........ | 0.02 | 2 |
| E.... | F.....N...IN.P...L | .QPN......F......T | ...NDR | E.AR.NDAE.GS | A..A........ | 0.02 | 2 |
| A...T | F.....K....L.G.L | .Q.S......F...... | E..N.. | ........... | A..A........ | 0.02 | 2 |

TABLE 5-continued

AAV capsid proteins having increased specificity for and/or transduction of
CD44⁺/133⁺ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| TA..T | ................... | .PPNG.....F......T | ...DDR | ........... | A..A........ | 0.02 | 2 |
| D...T | ................... | ................... | R..AD. | E.T..S..A..R | A..A........ | 0.02 | 2 |
| .A... | ................... | .KYT.....NF......T | ...D.R | ESATGD..E.GQ | A..A........ | 0.02 | 2 |
| ..... | F.................. | .V.......F....... | ...... | ........... | GRSAP..SG..T | 0.02 | 2 |
| ..... | ................... | ................... | ...DD. | .SG..ND...DG | A..A........ | 0.02 | 2 |
| ....T | ................... | ..AGR....DF......T | ....D. | ........... | A..A........ | 0.02 | 2 |
| ..... | ................... | .V......F....... | ...... | ........... | NP.AP..DRG.P | 0.02 | 2 |
| GA... | ................... | ..HG.....NF......T | R..DD. | ........... | ........... | 0.02 | 2 |
| ..... | ................... | ...........NF..... | R...D. | EDAGAA..EFGQ | A..A........ | 0.02 | 2 |
| E.... | F.....GTG.P....K.. | ...NG.....F....... | R..DD. | E.AG...IAVDR | A..A........ | 0.02 | 2 |
| RT... | F.................. | .V.......F....... | ...... | ........... | AQQNP..IRG.A | 0.02 | 2 |
| ..... | F.....DRG.N..I.A.K | .KYT.....NF....... | R..D.. | ........... | ETKSG..YR..T | 0.02 | 2 |
| SA... | F.....NGT.IL.T.A.K | .QHNQ.....F......T | ...... | .D.GA.DAEVDG | A..A........ | 0.02 | 2 |
| ..... | F.................. | .V.......F....... | ...... | ........... | GAKG....HV.. | 0.02 | 2 |
| ..... | ................... | ................... | E..DG. | ........... | GRRDP..DTI.P | 0.02 | 2 |
| GA... | ................... | ................... | ...... | ........... | ........... | 0.02 | 2 |
| ..... | ................... | ................... | ...D.. | EDAGR..IEY.. | A..A........ | 0.02 | 2 |
| ..... | F.......G.N..T.P.L | TQ.TG....DF....... | ...DDR | ........... | A..A........ | 0.02 | 2 |
| ..... | ................... | ................... | R...D. | ...TAS.IA..G | A..A........ | 0.02 | 2 |
| RA... | ................... | .Q.S......F....... | E..AGR | E..GA.D.EYGQ | A..A........ | 0.02 | 2 |
| ..... | S.................. | .V.......F....... | ...... | ........... | NPRAP..SET.A | 0.02 | 2 |
| G...T | ................... | ...........F..... | R..DG. | ..ATESD..FDQ | A..A........ | 0.02 | 2 |
| ..... | ................... | ................... | ...KD. | ........... | A..A........ | 0.02 | 2 |
| ..... | ................... | ................... | R..DD. | .NGG.ND....Q | A..A........ | 0.02 | 2 |
| ..... | F.....SG..IK.K.D.R | ........NF......T | ...DDR | ........... | ........... | 0.02 | 2 |
| S.... | ................... | .QANH.....F......T | G..ND. | EDAG...I..GQ | A..A........ | 0.02 | 2 |
| GA... | F.....DH..R..P.G.S | .Q.DQ.....F....... | ....D. | ........... | A..A........ | 0.02 | 2 |
| D...T | F.................. | ................... | E..AD. | E.......... | A..A........ | 0.02 | 2 |
| ..... | ................... | ................... | ....D. | ........... | A..A........ | 0.02 | 2 |
| R.... | ................... | ...........F..... | R..TGR | ...G.D..EVGQ | A..A........ | 0.02 | 2 |
| ..... | ..........SP.H.E.V | ..HC.....NF......T | ...DDR | E.AGAND.AV.H | A..A........ | 0.02 | 2 |
| ..... | ................... | .KYT.....NF..P...T | R..D.. | ........... | A..A........ | 0.02 | 2 |
| DT... | ................... | ...........NF..... | ...DDR | ESGRRS..E..Q | A..A........ | 0.02 | 2 |
| ..... | ................... | ................... | ...ADR | E.AG..D.A.GR | A..A........ | 0.02 | 2 |
| ..... | ................... | ..PNG....DF....... | R..AGR | ........... | A..A........ | 0.02 | 2 |
| ..... | ................... | .........DF....... | ...DG. | ESAAAADT..GN | A..A........ | 0.02 | 2 |

TABLE 5-continued

AAV capsid proteins having increased specificity for and/or transduction of
CD44+/133+ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| GA... | F.....DRG.S..T.A.S | ..DGE....DF....... | ...... | .......... | ............ | 0.02 | 2 |
| S.... | F......HG.I..M.Q.R | TKDT.....NF....... | ...... | E.AG.A..EF.R | A..A........ | 0.01 | 1 |
| NT..T | F......HG.LV.L.K.R | .QAS......F....... | ...... | .......... | A..A........ | 0.01 | 1 |
| .T... | .....ASA.S..T.T.G | .QPG.....DF....... | ...DDR | .......... | A..A........ | 0.01 | 1 |
| ..... | ................. | ............. | ....D. | ..ASE...E.D. | A..A........ | 0.01 | 1 |
| S.... | ................. | TKDDR....DF....... | ....D. | ...AAA.IE..Q | A..A........ | 0.01 | 1 |
| TT..T | ................. | ................. | ...... | .......... | .D.......... | 0.01 | 1 |
| T.... | ................. | .........NF....... | R..DG. | .DTTRG.A.VDQ | A..A........ | 0.01 | 1 |
| TA..T | F.....ST..SV.K.H.M | TQPTE....DF....... | G..ND. | .......... | ............ | 0.01 | 1 |
| ..... | F.....A.G..V.T.H.R | .Q.DR.....F....... | ....D. | ..AAGAD.EV.. | A..A........ | 0.01 | 1 |
| EA..T | .....NQG..V.L.N.R | .QPN......F......T | ...N.. | .NGGGN...VDQ | .........Y.. | 0.01 | 1 |
| ..... | ................. | .QPG.............. | G..DD. | .......... | ............ | 0.01 | 1 |
| ..... | ................. | ................. | R...D. | .......... | A........... | 0.01 | 1 |
| ..... | F.....AST.HD.T.E.R | TKAGE....NF..P...T | E..AD. | ..A.ASDA.V.Q | A..A........ | 0.01 | 1 |
| ..... | F................. | .V.....D..F....... | ...... | .......... | ERSGA..IE..D | 0.01 | 1 |
| ..... | ..........SPAH.E.V | ..HG.....NF......T | ...DDR | E.AGAMD.AV.H | A..A........ | 0.01 | 1 |
| DA... | F.....AST.HDMT.E.R | T.PGG....NF....... | ...DDR | ESAKTSDAAVDD | A..A........ | 0.01 | 1 |
| ..... | ................. | ................. | R..DG. | .DAGA.D.AV.E | A..A........ | 0.01 | 1 |
| ..... | ................. | ................. | ....DR | .......... | ............ | 0.01 | 1 |
| ..... | ................. | ................. | R..DD. | .NAGGNDIA.GE | A..A........ | 0.01 | 1 |
| GT... | ................. | ..HG.....NF......T | E..DD. | .......... | EKRGA..V...H | 0.01 | 1 |
| ..... | F.....ANG.HL.K.K.S | ..DGE....DF....... | ...... | .......... | A..A........ | 0.01 | 1 |
| EA... | F.....SSA..V.H.H.. | ................. | ...... | .......... | ............ | 0.01 | 1 |
| RA..T | F......GA.HP.K...V | ..DGE....DF....... | ...... | .......... | A..A........ | 0.01 | 1 |
| ..... | F................. | .V.......F....... | ...... | .......... | NARGT..AQV.D | 0.01 | 1 |
| EA... | F.....AGT..M.K.Q.G | .PPNG.....F......T | ...DDR | .......... | A..A........ | 0.01 | 1 |
| ..... | F.....D...S..M.T.R | ................. | ...... | .......... | A..A........ | 0.01 | 1 |
| SA... | ......NQG....P.K.I | .Q.DR.....F....... | E..AD. | .......... | ............ | 0.01 | 1 |
| ..... | ................. | ................. | ...D.. | ENAG.G.IT.DQ | A..A........ | 0.01 | 1 |
| T.... | ................. | TKDT.....NF....... | R...D. | ..GGA.D.E.GN | ANKDP..FKE.. | 0.01 | 1 |
| ..... | F.....GNG.HV.H.G.R | ..YN......F......T | ...... | .......... | APQDR..DTN.T | 0.01 | 1 |
| NA..T | ................. | .........DF....... | ...D.. | .D..TA....GE | ............ | 0.01 | 1 |
| EA... | ................. | .QANH....DF....... | ...DDR | .......... | A..A........ | 0.01 | 1 |
| ..... | ................. | ..DGE....DF....... | .....S | .NG..G.I...G | A..A........ | 0.01 | 1 |
| ..... | ................. | ................. | ....D. | .DART.D.A.DE | A..A........ | 0.01 | 1 |
| G.... | F......G..NL.T.E.R | .QDT......F......T | ...... | .......... | ............ | 0.01 | 1 |

TABLE 5-continued

AAV capsid proteins having increased specificity for and/or transduction of
CD44⁺/133⁺ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| GA... | F......S..PM.T.S.K | .Q.S......F....... | R..D.. | ............ | A..A........ | 0.01 | 1 |
| ..... | F................. | .V.......F....... | ...... | ............ | G.KTT..FTM.T | 0.01 | 1 |
| EA... | ................. | ................. | R..D.. | ............ | A..A........ | 0.01 | 1 |
| ..... | F......GT.NM.L.Q.G | ................. | ....D. | ............ | ............ | 0.01 | 1 |
| ..... | ................. | .V.......F....... | ...... | ............ | KEHTR..VN..D | 0.01 | 1 |
| ..... | ................. | ................. | ....GR | R.AG.N.AA.GQ | A..A........ | 0.01 | 1 |
| E.... | F.....STA..Q.H.Q.L | T.P......DF....... | R...D. | ............ | ............ | 0.01 | 1 |
| ..... | F................. | .V.......F....... | ...NG. | ENTTGN....DR | A..A........ | 0.01 | 1 |
| ..... | .........SP.H.EPV | ..HG.....NF......T | ...DDR | E.AGAND.AV.H | A..A........ | 0.01 | 1 |
| TA..T | F.....NGG.IM.L.E.R | T.P....D.DF....... | ....D. | ............ | ............ | 0.01 | 1 |
| DT... | F.....AEG.LK.M.H.L | ..DGE....DF....... | ...... | ............ | ............ | 0.01 | 1 |
| E.... | ................. | ................. | R..DG. | ENAGT...AFD. | A..A........ | 0.01 | 1 |
| SA... | ................. | ..A......DF....... | ...DG. | EDAGT...AFD. | A..A........ | 0.01 | 1 |
| N.... | ................. | TQ.TH....DF....... | ....D. | EN.GTN.AE.DN | A..A........ | 0.01 | 1 |
| ..... | ................. | .v.......F....... | ...... | ............ | AARGG..VSN.. | 0.01 | 1 |
| TA..T | F.....DE.....N...G | .QD.E....DF......T | .....S | .D..GA..EGVD | A..A........ | 0.01 | 1 |
| .A... | ................. | .V.......F....... | ...... | ............ | TARSA..VDG.A | 0.01 | 1 |
| ..... | F................. | .V.......F....... | ...... | ............ | GDRTT..DRV.E | 0.01 | 1 |
| RT... | F.....ANG.HL.K.K.S | ..DGE....DF....... | ...... | ............ | A..A........ | 0.01 | 1 |
| E.... | F................. | ................. | R...DR | E.GG.....F.S | A..A........ | 0.01 | 1 |
| HT... | F.........A.M.K.H | .QPG.....NF....... | ...DDR | E.ANG...E.G. | A..A........ | 0.01 | 1 |
| ..... | ................. | ................. | ....D. | E.AGAND.AY.N | A..A........ | 0.01 | 1 |
| TA... | F.....G....K.L...G | .KD.E.....F....... | ....D. | ENGSAA.A...E | A..A........ | 0.01 | 1 |
| ..... | F.....GRG.H..P.E.M | TQ.TG....DF...... | ...DDR | E..AAS....GG | A..A........ | 0.01 | 1 |
| ..... | ................. | .KYT.....NF......T | ...... | ............ | A..A........ | 0.01 | 1 |
| ..... | F.....GRG.H..P.E.R | .........F....... | ...... | .SASRND.AVGE | A..A........ | 0.01 | 1 |
| GA... | F.....STA..Q.H.Q.L | T.P......GF....... | R...D. | ............ | ............ | 0.01 | 1 |
| ..... | ................. | ................. | ...... | ..GGTD....DR | A..A........ | 0.01 | 1 |
| ..... | F.........A.M.K.H | TQ.TG....DF....... | ...DDR | E.AGGN...FGE | A..A........ | 0.01 | 1 |
| TA..T | ................. | ..HG.....NF......T | ...TDR | .SA....AEVDD | A..A........ | 0.01 | 1 |
| TT..T | ................. | ................. | ...... | ............ | .......T... | 0.01 | 1 |
| ..... | .........SP.H.EV | ..HGN....NF......T | ...DDR | E.AGAND.AV.H | A..A........ | 0.01 | 1 |
| ....P | ................. | ................. | R..N.. | ............ | A..A........ | 0.01 | 1 |
| TA..T | G.....SGA..K.N.S.S | ..HG.....NF......T | ...D.. | ..ADRS...VGS | A..A........ | 0.01 | 1 |
| ..... | ................. | ................. | ...DDR | .NAGAND.EV.G | A..A........ | 0.01 | 1 |
| G.... | ................. | ................. | ...... | ............ | GRRDP..DTI.P | 0.01 | 1 |

TABLE 5-continued

AAV capsid proteins having increased specificity for and/or transduction of
CD44$^+$/133$^+$ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263<br>QSGAS | 444<br>YLSRTNTPSGTTTQSRLQ | 490<br>KTSADNNNSEYSWTGATK | 527<br>KDDEEK | 545<br>QGSEKTNVDIEK | 585<br>RGNRQAATADVN | % | # |
|---|---|---|---|---|---|---|---|
| E.... | F.....GAT.IN.M.K.L | T.ANE....DF....... | ...DDR | ............ | ............ | 0.01 | 1 |
| GA... | F................. | TKDDR....DF....... | R..ND. | E.TARN..AAFDE | A..A........ | 0.01 | 1 |
| ..... | N................. | ................. | R..D.R | E.AAAA.I..D. | A..A........ | 0.01 | 1 |
| ..... | ................. | ................. | ....GR | E.AGGD..EV.R | A..A........ | 0.01 | 1 |
| ..... | ................. | .........P...... | ...... | ENGKAGD...GN | A..A........ | 0.01 | 1 |
| ..... | ................. | ......NF......T | R..AD. | ............ | A..A........ | 0.01 | 1 |
| ..... | ................. | .......F....... | ...... | .DT.RS.I...R | A..A........ | 0.01 | 1 |
| GT... | F.....AEG.LK.M.H.L | ..DGE....DF....... | ...... | E.ATRA..A.DE | A..A........ | 0.01 | 1 |
| .A... | ................. | ..DGE....DF....... | R..DD. | ............ | ............ | 0.01 | 1 |
| ..... | ................. | ...............T | ...ADR | ............ | A..A........ | 0.01 | 1 |
| ..... | ................. | ......NF..P.... | ....D. | ............ | A..A........ | 0.01 | 1 |
| .T... | ................. | .V.......F....... | ...... | ............ | GR.DT..FTE.D | 0.01 | 1 |
| .A... | F.....G.T.II.P.D.R | E................. | ...DG. | ............ | A..A........ | 0.01 | 1 |
| G.... | F.....SGG.RV.P...G | .QPTG....NF....... | R...D. | ............ | ............ | 0.01 | 1 |
| T.... | F.....GH..HE.T.T.E | ..DGE....DF....... | ...... | ............ | A..A........ | 0.01 | 1 |
| ..... | F.....SA..RA.....R | TKDR.....DF..I.... | ...DDR | E..A.ADA..GD | A..A........ | 0.01 | 1 |
| ..... | ..RQNKH...SP.H.E.V | ..HG.....NF......T | ...DDR | E.AGAND.AV.H | A..A........ | 0.01 | 1 |
| GA... | ................. | .PPNG....F......T | ...DDR | ............ | A..A........ | 0.01 | 1 |
| ..... | ................. | T.HTE....NF......T | ...NDR | ............ | A..T........ | 0.01 | 1 |
| ..... | F......TG.KA.I.G.K | .PHD.....DF......T | ...D.R | ........E... | A..A........ | 0.01 | 1 |
| ..... | F.....NN..N..M...G | .Q.DR.....F....... | ...DDR | ............ | AC.A........ | 0.01 | 1 |
| ..... | F.....N.G.RE.H.A.R | .Q.DR.....F....... | ....D. | ............ | A..A........ | 0.01 | 1 |
| ..... | .........SP.H.E.V | ..HG.....NF......T | ...DDR | ECAGAND.AV.H | A..A........ | 0.01 | 1 |
| A.... | ................. | TQASG....NF....... | ....D. | E.AS...IEYGQ | A..A........ | 0.01 | 1 |
| D...T | F......QA.IN.H.H.K | .KD.E.....F..P...T | R..TG. | ............ | A..A........ | 0.01 | 1 |
| ..... | F.....SGT.SQ.K.E.. | .KYT.....NF......T | ...DDR | ............ | ............ | 0.01 | 1 |
| ..... | F.....AAG..E.T.... | .QPNY.....F......T | ...N.. | ............ | A..A........ | 0.01 | 1 |
| ....T | ................. | ................. | G..KG. | .SADGSD...DR | A..A........ | 0.01 | 1 |
| ..... | ................. | TK.NW....DF......T | ...D.R | .NAAAN.A.Y.S | A..A........ | 0.01 | 1 |
| GT... | F................. | .V.......F....... | ...... | ............ | GRRDP..DTI.P | 0.01 | 1 |
| ..... | F................. | .V.......F....... | ...... | ............ | E.RSP..FTI.Q | 0.01 | 1 |
| TA... | ................. | .KYT.....NF | R...D. | ED.GGND.EV.D | A..A........ | 0.01 | 1 |
| T.... | F......EG.NA.P.E.R | ..PN.....NF....... | ...D.R | .SAKAA.AA.DE | A..A........ | 0.01 | 1 |
| EA... | F.....GG.NA.I...R | T.YNH....F....... | ...D.. | ............ | A..A........ | 0.01 | 1 |
| ..... | F.....DQ..R..P.S.R | .QD.E.....F..P.... | ....S | E.GKGSD...GG | A..A........ | 0.01 | 1 |
| ..... | ................. | ................. | ...... | ESATRG.....R | A..A........ | 0.01 | 1 |

TABLE 5-continued

AAV capsid proteins having increased specificity for and/or transduction of
CD44$^+$/133$^+$ GSC (pool of Round 1 selection). Amino acid numbers correspond
to the amino acid sequence of VP1 (SEQ ID NO: 1). Sequences below correspond
to SEQ ID NOs: 8 and 3731-4667 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | F................. | .V.......F....... | ...... | ............ | GRQSP..DRA.E | 0.01 | 1 |
| ..... | ................. | E................. | ....GR | ..AG.N.AA.GQ | A..A........ | 0.01 | 1 |
| D.... | F.....SG..SH.T.G.G | ..P......DF....... | ...DDR | .SG..ND...DG | A..A........ | 0.01 | 1 |
| .A... | F.....SGG.SH...A.R | ..P.E....NF......T | R...D. | ............ | A..A........ | 0.01 | 1 |
| ..... | F................. | .V.......F....... | ...... | ............ | AP.SK..DN..T | 0.01 | 1 |
| ..... | ................. | .V.......F....... | ...... | ............ | ............ | 0.01 | 1 |
| ..... | ......NQG..V.L.N.R | .QPN......F......T | ...N.. | .NGGGN...VDQ | ............ | 0.01 | 1 |
| NA... | ................. | ................. | ...DDR | ..TTGA.I.FDG | A..A........ | 0.01 | 1 |
| TT..T | ................. | ................. | .....S | ............ | ............ | 0.01 | 1 |
| AA... | ................. | T.Y.G....NF....... | ...... | E.AGTNDI...R | A..A........ | 0.01 | 1 |

TABLE 6

AAV capsid proteins having increased specificity for and/or transduction of
CD44$^+$/133$^+$ GSC (pool of Round 2 selection). Amino acid numbers correspond to the
amino acid sequence of VP1 (SEQ ID NO: 1). Sequences below correspond to SEQ ID
NOs: 8 and 4668-4705 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| G...T | ................. | ..HDR....NF....... | ....D. | ............ | A..A........ | 11.20 | 236 |
| TT..T | ................. | .QPTG....NF....... | ...DDR | E.GNG.D.E.DS | A..A........ | 10.28 | 223 |
| ..... | ................. | ................. | ....GR | ..AG.N.AA.GQ | A..A........ | 6.88 | 145 |
| TA... | F.....SKA.S..L.E.R | ................. | ...D.. | ............ | A..A........ | 6.36 | 134 |
| ..... | ................. | .........DF....... | ...D.. | E.ASGG.A..GS | A..A........ | 6.07 | 128 |
| GT... | F.....AEG.LK.M.H.L | ................. | ...... | ............ | ............ | 6.07 | 128 |
| T.... | F.....SRA.SK.N.A.H | .Q.S......F....... | G..D.. | ............ | A..A........ | 6.03 | 127 |
| ..... | F................. | .V........F....... | ...... | ............ | GERTP..ART.D | 5.60 | 118 |
| ..... | ................. | ................. | ...DD. | .NGST.....GG | A..A........ | 5.55 | 117 |
| ..... | ................. | ................. | ...N.. | ...G.N.A.... | A..A........ | 5.03 | 106 |
| DA... | F.....DNA.NA.M.N.K | ..PNG....DF....... | G..NDR | ............ | A..A........ | 5.03 | 106 |
| ..... | F.....AEG.LK.M.H.L | ..DGE....DF....... | ...... | ............ | ............ | 4.03 | 85 |
| ..... | ................. | ................. | ...N.. | ENAGGD..E..R | A..A........ | 3.27 | 69 |
| ..... | ................. | ................. | ...DDR | ............ | ............ | 3.18 | 67 |
| ..... | F......GT.NM.L.Q.G | .Q.S......F....... | ....D. | ............ | ............ | 2.99 | 63 |
| .A... | F.....ANG.HL.K.K.S | T.P......DF....... | R..D.. | ............ | A..A........ | 2.42 | 51 |
| ..... | F................. | .V.......F....... | ...... | ............ | DRQGN..IGV.. | 1.85 | 39 |
| N.... | F................. | .V.......F....... | ...... | ...........R | A..A........ | 1.33 | 28 |
| ..... | F................. | .V.......F....... | ...... | ............ | GRKGG...NV.E | 1.14 | 24 |

TABLE 6-continued

AAV capsid proteins having increased specificity for and/or transduction of CD44+/133+ GSC (pool of Round 2 selection). Amino acid numbers correspond to the amino acid sequence of VP1 (SEQ ID NO: 1). Sequences below correspond to SEQ ID NOs: 8 and 4668-4705 from top to bottom.

| 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % | # |
|---|---|---|---|---|---|---|---|
| ..... | .................. | ................. | ...ADR | .......... | A..A........ | 0.81 | 17 |
| TA... | .................. | ................. | ....D. | .DTAA...EF.G | A..A........ | 0.57 | 12 |
| ..... | .................. | .QD.E.....F..P.... | ...D.. | .......... | .......... | 0.33 | 7 |
| ..... | .................. | ................. | ...... | E.AG...TAVGN | A..A........ | 0.28 | 6 |
| ..... | F................. | .V........F...... | ...... | .......... | DHRAT..SNN.D | 0.19 | 4 |
| GT... | F.....AEG.LK.M.H.L | ..DGE....DF....... | .G.... | .......... | .......... | 0.09 | 2 |
| ..... | .................. | ........G......... | ....GR | ..AG.N.AA.GQ | A..A........ | 0.09 | 2 |
| G...T | .................. | ..HDR....NF....... | ....D. | .......... | A..T........ | 0.09 | 2 |
| SA... | .................. | ..DGE....DF....... | ...... | ENASGG.AE.DS | A..A........ | 0.09 | 2 |
| TA... | F.....SKA.S..L.EFR | ................. | ...D.. | .......... | A..A........ | 0.09 | 2 |
| ..... | F................. | .V........F...... | ...... | .......... | TRSAP..FNT.E | 0.05 | 1 |
| ..... | .................. | ........DF....... | ...D.. | E.ASEAMPTSAS | A..A........ | 0.05 | 1 |
| ..... | ....A............. | ................. | ...N.. | ENAGGD..E..R | A..A........ | 0.05 | 1 |
| ..... | .................. | ................. | ....G. | E.AG...IAVDR | A..A........ | 0.05 | 1 |
| ..... | .................. | ................. | ....D. | E.GGTG.AEFDQ | A..A........ | 0.05 | 1 |
| ..... | .................. | ..DGE....DF....... | ...... | E.......... | A..A........ | 0.05 | 1 |
| ..... | .................. | ................. | ....GG | ..AG.N.AA.GQ | A..A........ | 0.05 | 1 |
| TA... | .................. | .QANH....DF....... | ...DDR | .......... | .......... | 0.05 | 1 |
| A.... | .................. | .........NF....... | R...D. | ..AK.ADT..GN | A..A........ | 0.05 | 1 |

TABLE 7

AAV capsid proteins having increased specificity for and/or transduction of CD44+ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | .................. | ................. | ....GR | ..AG.N.AA.GQ | A..A........ | 1.75 | 287 |
| E.... | F.....ASA.S..T.T.G | .QPG.....DF....... | ...DDR | .......... | .......... | 1.47 | 240 |
| ..... | .................. | ................. | ...DDR | .......... | A..A........ | 0.83 | 136 |
| ..... | F.....AEG.LK.M.H.L | ..DGE....DF....... | ...... | .......... | .......... | 0.78 | 127 |
| ..... | .................. | ................. | ...... | .......... | A..A........ | 0.76 | 125 |
| ..... | F................. | .V........F...... | ...... | .......... | .......... | 0.74 | 121 |
| TA... | .................. | .QANH....DF....... | ...DDR | .......... | A..A........ | 0.59 | 97 |
| ..... | .................. | ................. | R..DD. | .......... | .......... | 0.58 | 95 |
| D...T | F......GT.NM.L.Q.G | .Q.S.....F....... | ....D. | .......... | .......... | 0.56 | 92 |
| ..... | .................. | ................. | R...D. | .......... | A..A........ | 0.53 | 87 |
| GT... | F.....AEG.LK.M.H.L | ..DGE....DF....... | ...... | .......... | .......... | 0.52 | 85 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| H.... | ................... | ..DGE....DF....... | R...D. | ........... | ........... | 0.51 | 83 |
| ..... | ................... | ................... | E..ND. | ........... | A..A........ | 0.51 | 83 |
| ..... | ................... | ................... | ...NDR | ..AKG...AV.. | A..A........ | 0.46 | 75 |
| ..... | ................... | ................... | ...N.. | ........... | A..A........ | 0.45 | 74 |
| TT..T | ................... | ................... | ...... | ........... | ........... | 0.44 | 72 |
| ..... | F.................. | .V........F....... | ...... | ........... | GPHGP..DGM.. | 0.43 | 71 |
| GT... | ................... | ..HG.....NF......T | E..DD. | ........... | ........... | 0.42 | 68 |
| ..... | F.....ASA.S..T.T.G | .QPG.....DF....... | ...DDR | ........... | ........... | 0.38 | 63 |
| ..... | ................... | ..P.G....NF....... | R...D. | ...NG....VDG | A..A........ | 0.38 | 62 |
| A...T | ................... | TQP.R....NF......T | ...D.. | ........... | A..A........ | 0.33 | 54 |
| ..... | ................... | ................... | G..KD. | ESAGAN....GG | A..A........ | 0.32 | 53 |
| ..... | ................... | ................... | E..AG. | ........... | ........... | 0.32 | 53 |
| ..... | ................... | .Q.S.....F........ | ...... | E.AS.N.IE.GS | A..A........ | 0.32 | 53 |
| ..... | ................... | .QD.E.....F..P.... | ...D.. | ........... | ........... | 0.32 | 52 |
| ..... | ................... | ................... | R...AD | ........... | A..A........ | 0.32 | 52 |
| ..... | ................... | ................... | E..N.. | ..AG.N.AA.GQ | A..A........ | 0.31 | 51 |
| ..... | F.................. | .QDT......F......T | ...D.. | ESGNRN.IAF.E | A..A........ | 0.30 | 49 |
| G...T | ................... | ..HDR....NF....... | ....D. | ........... | A..A........ | 0.30 | 49 |
| ..... | F.................. | .V........F....... | ...... | ........... | A..A........ | 0.30 | 49 |
| ..... | ................... | ................... | G..DG. | ........... | ........... | 0.30 | 49 |
| .A... | F.....DRG.S..T.A.S | ..DGE....DF....... | ...... | ........... | ........... | 0.29 | 47 |
| E.... | F.....AEG.LK.M.H.L | ..DGE....DF....... | ...... | ........... | ........... | 0.29 | 47 |
| ..... | ................... | TQYDR....NF....... | E...G. | ........... | A..A........ | 0.29 | 47 |
| GT... | ................... | ................... | G..N.. | ........... | A..A........ | 0.28 | 46 |
| ..... | ................... | ................... | E..TG. | ........... | ........... | 0.27 | 44 |
| ..... | ................... | ................... | R..AG. | ........... | A..A........ | 0.27 | 44 |
| ..... | ................... | ................... | E..DD. | ........... | A..A........ | 0.26 | 43 |
| ..... | ................... | ................... | ...D.. | E.AKGG..A.DQ | A..A........ | 0.26 | 43 |
| E.... | F.....ASA.S..T.T.G | .QPG.....DF....... | ...DDR | ........... | A..A........ | 0.26 | 42 |
| A.... | F.....DA..IA.L.K.R | .KDSR....DF......T | R..DD. | ........... | A..A........ | 0.25 | 41 |
| NA..T | F.....ANG.HL.K.K.S | T.P......DF....... | ...D.. | ........... | A..A........ | 0.25 | 41 |
| NA... | ................... | ..HG.....NF....... | ...NGR | ........... | A..A........ | 0.24 | 40 |
| ..... | ................... | .PHD.....DF......T | ...DG. | ........... | A..A........ | 0.24 | 39 |
| ..... | ................... | ................... | ...DDR | ..AS...I..G. | A..A........ | 0.24 | 39 |
| ..... | ................... | ................... | ...D.. | ........... | A..A........ | 0.24 | 39 |
| ..... | F.................. | .V........F....... | ...... | ........... | SHRA...ATV.H | 0.23 | 37 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | .................. | .PPNG.....F......T | ...DDR | E.TR.N.....Q | A..A........ | 0.23 | 37 |
| GT..T | G.....G.G.IN.L...V | .........DF....... | ...DDR | .STSA..AAY.D | A..A........ | 0.22 | 36 |
| TA... | .................. | TQPTH....NF...... | R..DD. | ............ | A..A........ | 0.22 | 36 |
| ET... | F.....SGT.S..P.A.K | ..HG.....NF...... | ...... | E........... | A..A........ | 0.21 | 35 |
| ..... | F.....DRG.S...T.A.S | ..DGE....DF...... | ...... | ............ | ............ | 0.21 | 35 |
| ..... | .................. | .PPNG.....F......T | ...DDR | E.ATRA..A.DE | A..A........ | 0.21 | 35 |
| ..... | .................. | .................. | R...D. | ...AAS.A.VGQ | A..A........ | 0.21 | 34 |
| ..... | .................. | .................. | R...D. | E.AG..D.A.GR | A..A........ | 0.21 | 34 |
| ..... | F................. | .QD.E.....F..P.... | ...D.. | ............ | ............ | 0.21 | 34 |
| ..... | .................. | .................. | E..N.. | ..TK...AE..D | ............ | 0.20 | 33 |
| DT... | ......AST.IN.L.T.. | ..DGE....DF....... | ...... | ............ | ............ | 0.20 | 32 |
| D...T | F.....NA..LV.I.D.R | .QPG.....NF...... | ...DDR | .DAG.S.A..DR | A..A........ | 0.20 | 32 |
| RA... | .................. | .................. | ..AG. | ............ | A........... | 0.20 | 32 |
| ..... | F................. | .V........F....... | ...... | ............ | GRSAD..DTS.H | 0.19 | 31 |
| E.... | .................. | .................. | ...DDR | ............ | ............ | 0.19 | 31 |
| ..... | F................. | .V........F...... | ...... | ............ | ANSNP..SDS.Q | 0.19 | 31 |
| D...T | F.....ASA.S..T.T.G | .QPG.....DF....... | ...DDR | ............ | A..A........ | 0.19 | 31 |
| ..... | .................. | .................. | ...... | E.TARG.A.F.S | A..A........ | 0.19 | 31 |
| GT... | .................. | .QPN......F......T | ....D. | ............ | A..A........ | 0.18 | 30 |
| ..... | .................. | .................. | ...DDR | .D.AG..T..GQ | A..A........ | 0.18 | 30 |
| ..... | .................. | .................. | R..DD. | EN.KAN....GG | A..A........ | 0.18 | 30 |
| ..... | .................. | .................. | R..A.. | ED.NCN.IA.D. | A..A........ | 0.18 | 30 |
| ..... | .................. | .................. | ...N.. | .SAKAA.AA.DE | A..A........ | 0.18 | 29 |
| ....T | .................. | ..AGR....DF......T | ....D. | ............ | A..A........ | 0.18 | 29 |
| S.... | F.....SRA.SK.N.A.H | TKP.....DF....... | G..K.. | ............ | A..A........ | 0.18 | 29 |
| ..... | .................. | .................. | T..TG. | ............ | A..A........ | 0.18 | 29 |
| ..... | F.....S.T.NV.L.D.. | .QPSQ....NF....... | ...... | E.AS.A.TAV.H | A..A........ | 0.18 | 29 |
| ..... | .................. | .................. | ...DG. | ............ | A..A........ | 0.17 | 28 |
| .A... | F.....SNG.RE.L...K | TQ.TG....NF...... | ...... | ............ | A..A........ | 0.17 | 28 |
| ..... | .................. | .................. | ...A.. | .NAGRDD.A..E | A..A........ | 0.17 | 28 |
| TA... | .................. | .QAS......F....... | ...... | .DATA..A.Y.H | A..A........ | 0.17 | 28 |
| R.... | .................. | TKAT....NF......T | G..TG. | ............ | A..A........ | 0.17 | 28 |
| ..... | .................. | .DGG.....NF....... | R..ND. | E.ATGD..EV.. | A..A........ | 0.17 | 28 |
| ..... | .................. | .................. | ...DD. | ............ | A..A........ | 0.16 | 27 |
| .A... | .................. | ..PNG....DF....... | ...DDR | E.ADGS..E.GN | A..A........ | 0.16 | 27 |
| ..... | .................. | ..AGR....DF......T | R..D.. | .D.......... | A..A........ | 0.16 | 27 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | .................. | ..DGE....DF....... | R...D. | ............ | ............ | 0.16 | 27 |
| GA... | .................. | ..HG.....NF......T | ...DDR | .S.SGN.I..GN | A..A........ | 0.16 | 27 |
| ..... | .................. | .QDT......F......T | ...T.R | ............ | A..A........ | 0.16 | 27 |
| ..... | .................. | .................. | G..N.. | ............ | ............ | 0.16 | 27 |
| ..... | F................. | .V........F....... | ...... | ............ | TERGT..SD... | 0.16 | 27 |
| EA... | F.....ATT..N.L...L | .................. | ...... | ..TNESD..... | A..A........ | 0.16 | 27 |
| RA... | .................. | .................. | E..KG. | ............ | ............ | 0.16 | 27 |
| ..... | .................. | .................. | ...... | E.ADGA..AYDR | A..A........ | 0.16 | 26 |
| ..... | F.....A.A.RE.I.... | TKAT.....NF......T | R..AG. | ESAG....A.GE | A..A........ | 0.16 | 26 |
| ..... | F.....AQ...A.L.... | ..DNH....NF....... | G...G. | ............ | A..A........ | 0.15 | 25 |
| ..... | .................. | .................. | ...DDR | .N.G.N.A.VDN | A..A........ | 0.15 | 25 |
| T...T | F.....ATT.NV.T.K.S | T.P......DF....... | ...D.. | ..AAE.D....N | A..A........ | 0.15 | 25 |
| ..... | .................. | .................. | ...NGR | ............ | A..A........ | 0.15 | 25 |
| ..... | .................. | .................. | R..D.. | .SAGAN..E..S | A..A........ | 0.15 | 25 |
| ..... | F................. | .V........F....... | ...... | ............ | TARTA..SQV.H | 0.15 | 25 |
| NA..T | F......KA.LA.K.D.M | .V........F....... | ...... | E.AT.S.AAF.E | A..A........ | 0.15 | 24 |
| ..... | .................. | .................. | ...... | .NGGAADAE..H | A..A........ | 0.15 | 24 |
| ..... | .................. | .................. | ...DDR | E.A........ | A..A........ | 0.15 | 24 |
| ..... | F................. | .QHNQ.....F......T | R..DD. | ............ | A..A........ | 0.15 | 24 |
| ..... | .................. | .................. | ....D. | ............ | A..A........ | 0.15 | 24 |
| ..... | .................. | ........F....... | R..ND. | ENAA.G.TA.DE | A..A........ | 0.15 | 24 |
| ..... | ......SG..IK.K.D.R | .KPDQ....DF....... | ...D.. | .NATG....VGS | A..A........ | 0.15 | 24 |
| ..... | .................. | .................. | G..A.R | ............ | A..A........ | 0.14 | 23 |
| ..... | F.....AEG.LK.M.H.L | ..DGE....DF....... | ...D.. | ............ | ............ | 0.14 | 23 |
| ..... | .................. | ........F....... | ....DR | ..GKED...VDQ | A..A........ | 0.14 | 23 |
| ..... | .................. | ........D....... | G..K.. | ............ | A..A........ | 0.14 | 23 |
| ..... | .................. | .................. | ...AGR | ..AG.DD...GG | A..A........ | 0.14 | 23 |
| ..... | .................. | .KYT.....NF....... | ...NDR | ED.R.S.A...G | A..A........ | 0.14 | 23 |
| DT... | F.....SRT.IQ.....G | ..YN......F......T | ...... | ............ | A..A........ | 0.14 | 23 |
| N.... | .................. | ..HDR....NF....... | ....D. | EDAGAA..EFGQ | A..A........ | 0.14 | 23 |
| RA... | F.....G.G.HA.T.G.R | .Q.GQ...DF....... | R...D. | .DGTGA..E..E | A..A........ | 0.13 | 22 |
| ..... | F.....NN..N..M...G | ..PDG....DF....... | R..D.. | .DAAG..IAFDQ | A..A........ | 0.13 | 22 |
| ..... | .................. | .................. | ...DDR | ...GT..AA.GD | A..A........ | 0.13 | 22 |
| NT... | F.....DQT.PL.T...R | ..AGQ....NF....... | ...D.. | .DGGGAD.A.D. | A..A........ | 0.13 | 22 |
| D.... | F.....ATT.HP.L.T.L | TQADR....NF......T | G..TD. | .SAKAA.AA.DE | A..A........ | 0.13 | 22 |
| ..... | F................. | .V........F....... | ...... | ............ | G.RN...F.V.A | 0.13 | 22 |

TABLE 7-continued

AAV capsid proteins having increased specificity for and/or transduction of CD44+ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 | 444 | 490 | 527 | 545 | 585 | % | # |
| QSGAS | YLSRTNTPSGTTTQSRLQ | KTSADNNNSEYSWTGATK | KKDEEK | QGSEKTNVDIEK | RGNRQAATADVN | | |
|---|---|---|---|---|---|---|---|
| TA..T | F.....AGG.IV.L.G.R | ..DGE....DF....... | ...... | E.GA.N..A..G | A..A........ | 0.13 | 22 |
| ..... | .................. | .................. | R..N.. | E.GAGAD...GQ | A..A........ | 0.13 | 22 |
| ..... | .................. | .................. | E....R | ............ | A..A........ | 0.13 | 22 |
| SA... | .................. | .KYT.....NF......T | R..AGR | ENAG.SD.E..H | A..A........ | 0.13 | 22 |
| ..... | .................. | .........DF....... | ...DDR | ............ | A..A........ | 0.13 | 22 |
| ..... | .................. | .................. | R..DD. | ............ | A..A........ | 0.13 | 21 |
| ..... | .................. | ................T | ...DDR | E.ANG...E.G. | A..A........ | 0.13 | 21 |
| TA..T | .................. | .........DF....... | ....D. | ESGS.S.IA.DQ | A..A........ | 0.13 | 21 |
| ..... | .................. | .................. | R...D. | ..TG.A.I..D. | A..A........ | 0.13 | 21 |
| TA... | F.....GGG.LD.T...R | .Q.DR.....F....... | ....D. | ............ | A..A........ | 0.13 | 21 |
| N.... | .................. | TQ.TH....DF....... | ....D. | EN.GTN.AE.DN | A..A........ | 0.13 | 21 |
| ..... | .................. | .................. | ....DR | .NAATD...V.H | A..A........ | 0.13 | 21 |
| N.... | F.....GS..NM.N.T.R | ..DGE....DF....... | ...... | E.TTGNDI...R | A..A........ | 0.13 | 21 |
| R.... | .................. | ..DGE....DF....... | ...A.. | ..TK.GD..FGQ | A..A........ | 0.13 | 21 |
| ..... | .................. | .Q.DR.....F....... | ....D. | .NAA.A....GD | A..A........ | 0.13 | 21 |
| ..... | .................. | ................T | ...DDR | EDGDGA..A.DR | A..A........ | 0.13 | 21 |
| AT..N | .................. | ........F......T | ...DDR | ..AG.S...NGQ | A..A........ | 0.13 | 21 |
| NA... | F.....GRG.H..P.E.R | .QAS......F....... | ...... | .S.SGN.IE..D | A..A........ | 0.12 | 20 |
| AA... | F.....DG..PE.K.K.L | .V........F....... | ...... | E.AAG..T..GR | A..A........ | 0.12 | 20 |
| A.... | .................. | .QYGQ....DF......T | E..TGR | ...R.G....E | A..A........ | 0.12 | 20 |
| S.... | .................. | TKDDR....DF....... | ....D. | ...AAA.IE..Q | A..A........ | 0.12 | 20 |
| ..... | .................. | .........NF......T | G..DD. | ..TG.D..A.GG | A..A........ | 0.12 | 20 |
| HT... | F.....AGA.NK.L...K | .QAS.....NF......T | ...... | ............ | A..A........ | 0.12 | 20 |
| ..... | .................K | .................. | G..ND. | E.AG...IAVDR | A..A........ | 0.12 | 20 |
| ..... | F.....GGG.HN.H.T.M | ..HG.....NF......T | R..DR | ............ | A..A........ | 0.12 | 20 |
| N.... | F.....NKG.S..H.K.G | T..SE....DF..P...T | ....GR | ............ | A..A........ | 0.12 | 20 |
| ..... | .................. | .................. | ...... | .D.GA..IEV.Q | A..A........ | 0.12 | 20 |
| ..... | .................. | .................. | ...... | ..A..NDI..GR | A..A........ | 0.12 | 20 |
| ..... | .................. | .................. | ...DDR | ...GTND.AYDE | A..A........ | 0.12 | 19 |
| ..... | .................. | .................. | ...D.R | .DANRN..E.GQ | A..A........ | 0.12 | 19 |
| .A... | .................. | .................. | R..DD. | ............ | ............ | 0.12 | 19 |
| D...T | .................. | .QAS.....NF......T | ....GR | .NGGTG..A.DR | A..A........ | 0.12 | 19 |
| ..... | .F................ | .V........F....... | ...... | ............ | SRQNT...TN.D | 0.12 | 19 |
| SA... | .................. | .QPN......F......T | ...N.. | .D.GRAD.AF.S | A..A........ | 0.12 | 19 |
| ..... | .................. | .................. | ...ADR | .SAKAA.AA.DE | A..A........ | 0.12 | 19 |
| ..... | .F................ | .V........F....... | ...... | ............ | GSRSR..FE..T | 0.12 | 19 |

TABLE 7-continued

AAV capsid proteins having increased specificity for and/or transduction of
CD44+ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | F.....SA..SI.M.G.R | T.PNE....DF....... | R...D. | E.......... | ............ | 0.12 | 19 |
| ..... | .................. | ..DGE....DF....... | R...DR | ..T.GNDI..GN | A...A........ | 0.12 | 19 |
| ..... | .................. | .................. | E..NG. | ............ | ............ | 0.12 | 19 |
| ..... | .................. | .V........F....... | ...... | ..TGGSD.A.DN | A...AE....... | 0.12 | 19 |
| ..... | .................. | .................. | ...DDR | E.A.AD.AAF.. | A...A........ | 0.12 | 19 |
| ..... | .................. | .................. | R..D.. | ESAAGD.IE.GD | A...A........ | 0.12 | 19 |
| ..... | .................. | .................. | R..TGR | .NAG.DD...DQ | A...A........ | 0.11 | 18 |
| ..... | .................. | .................. | R...D. | .DGST.....GG | A...A........ | 0.11 | 18 |
| ..... | F.....DHT.R..M.G.R | .................. | ...... | ............ | A...A........ | 0.11 | 18 |
| ..... | F................. | .V........F....... | ...... | ............ | GPRDR..VKE.A | 0.11 | 18 |
| HT... | F......TA.PL.P.... | .QPG.....NF....... | ...DDR | ............ | A...A........ | 0.11 | 18 |
| ..... | F................. | .V........F....... | ...... | ............ | .AQTR..D.A.H | 0.11 | 18 |
| ..... | .................. | .................. | E..KD. | ............ | ............ | 0.11 | 18 |
| ..... | .................. | .................. | G..ND. | E..G.S.T.FDS | A...A........ | 0.11 | 18 |
| ..... | .................. | .........NF......T | R..TG. | .DGG.....Y.Q | A...A........ | 0.11 | 18 |
| ..... | F................. | .V........F....... | ...... | ............ | GTRNS..FRE.. | 0.11 | 18 |
| ..... | .................. | .................. | R..TD. | ............ | A...A........ | 0.11 | 18 |
| ..... | F................. | .................. | ...N.. | .SAKAA.AA.DE | A...A........ | 0.10 | 17 |
| ..... | .................. | .........DF....... | ...DDR | .SGTRA..A.GE | A...A........ | 0.10 | 17 |
| ..... | .................. | .................. | ...DD. | ..GNGN..E..S | A...A........ | 0.10 | 17 |
| GA... | .................. | .Q.DH....NF....... | ...DD. | ED.G.N....GR | A...A........ | 0.10 | 17 |
| ..... | F................. | .V........F....... | ...... | ............ | DKRDG..FKV.D | 0.10 | 17 |
| ..... | ..........P.A.K | .QPG.....NF....... | ...DDR | E.GGEN..EF.S | A...A........ | 0.10 | 17 |
| SA... | F......KT.NV.K.T.H | .................. | ...... | EDAG.AD.E.G. | A...A........ | 0.10 | 17 |
| ..... | .................. | .................. | ...... | E.AG.S...... | A...A........ | 0.10 | 17 |
| ..... | .................. | .................. | ...DDR | ..TNGA.IA..G | A...A........ | 0.10 | 17 |
| AA... | F.....AEG.LK.M.H.L | .DGE.....DF....... | ...... | ............ | ............ | 0.10 | 17 |
| ..... | F.....SGA..V.T.G.G | .V........F....... | ...... | ............ | A...A........ | 0.10 | 17 |
| ..... | .................. | .................. | ...NDR | ..TGAS.A..DH | A...A........ | 0.10 | 17 |
| GT... | .................. | .................. | ...... | ............ | ............ | 0.10 | 17 |
| ..... | .................. | .................. | ....D. | .DAGES..A.GD | A...A........ | 0.10 | 17 |
| ..... | F.....GDG....K.Q.R | .V........F....... | ...... | .NATG....VGS | A...A........ | 0.10 | 17 |
| AA... | .................. | .KAS.....NF......T | E..DD. | ............ | A...A........ | 0.10 | 17 |
| T.... | F.....ATA..V.H...R | .QAS......F....... | ...... | .SGDE.D.E.DR | A...A........ | 0.10 | 17 |
| ..... | .................. | .................. | E..NDR | ............ | A...A........ | 0.10 | 16 |
| G.... | .................. | .QANH....DF....... | ...DDR | ............ | A...A........ | 0.10 | 16 |

TABLE 7-continued

AAV capsid proteins having increased specificity for and/or transduction of CD44<sup>+</sup> GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | ................. | .Q.G.....F..P.... | ...... | E..TA.D...GR | A..A........ | 0.10 | 16 |
| ..... | F................. | .V........F....... | ...... | ............ | GRKGG...NV.E | 0.10 | 16 |
| ..... | F.....GS..NK.M.A.F | ..YN......F......T | ...D.R | ............ | A..A........ | 0.10 | 16 |
| ..... | F................. | .V........F...... | ...... | ............ | ATRA...VDN.. | 0.10 | 16 |
| D.... | F.....NTG.LH.T...R | ................. | ...DD. | EDGNAA....DQ | A..A........ | 0.10 | 16 |
| ..... | ................. | .QPGQ....NF....... | E..AD. | .SASEN.I..DR | A..A........ | 0.10 | 16 |
| NA..T | F.....GRG.HD...T.K | ..HG.....NF......T | ...A.. | E.ANGG.A...D | A..A........ | 0.10 | 16 |
| .A... | F.....NGG.NN.K.T.R | .V........F....... | ...... | ............ | A..A........ | 0.10 | 16 |
| ..... | ................. | ................. | ...D.. | .SAS.N.IA..E | A..A........ | 0.10 | 16 |
| ..... | F.....SD..HP.L.Q.K | .Q.DH....NF....... | ...DD. | ............ | A..A........ | 0.10 | 16 |
| ..... | ................. | ................. | ...D.. | ............ | GNKGS..VDI.T | 0.10 | 16 |
| ..... | F.....AAT.IN.N.D.K | ..DGE....DF......T | R...D. | ............ | A..A........ | 0.10 | 16 |
| ST... | F.....SAG..L.H...K | .QAS......F....... | ...... | ENAAGGDAE.GE | A..A........ | 0.10 | 16 |
| ..... | ................. | ..DGE....DF....... | R...D. | EN.GT..AA.GD | A..A........ | 0.10 | 16 |
| ..... | F.....GRT.PQ.T.T.R | ..YN......F......T | ...... | .N.KGAD.A.GE | A..A........ | 0.10 | 16 |
| ..... | ................. | ................. | ....GR | ENRAG......E | A..A........ | 0.10 | 16 |
| ..... | ................. | ................. | R..DDR | ............ | A..A........ | 0.10 | 16 |
| SA... | F.....GHA.SK.T.E.K | ...DG....DF....... | E..KD. | ............ | A..A........ | 0.10 | 16 |
| ..... | ................. | ..AGR....DF....... | ...D.. | .NAG.DD...DQ | A..A........ | 0.10 | 16 |
| ..... | ................. | ..PNG....DF....... | R..AGR | ............ | A..A........ | 0.10 | 16 |
| ..... | ................. | ................. | ...... | E.TGTA.AGVGE | A..A........ | 0.10 | 16 |
| E.... | F.....GH..P..P.S.V | .........NF....... | R...D. | ............ | A..A........ | 0.10 | 16 |
| ..... | F................. | .V........F....... | ...... | ............ | NTRDH..S.V.K | 0.10 | 16 |
| ..... | ................. | ....E.....F....... | ...... | .SAT.N.IA..H | A..A........ | 0.10 | 16 |
| ..... | F................. | .V........F....... | ...... | ............ | GQQTP..STT.H | 0.10 | 16 |
| HT... | F.....NTG.HP.T.G.M | T.P......DF....... | ...D.. | ............ | ............ | 0.10 | 16 |
| T.... | F.....NA..LV.I.D.R | ..PN.....NF....... | ...NDR | ............ | A..A........ | 0.10 | 16 |
| ..... | ................. | ................. | ....D. | EDGSED..A..Q | A..A........ | 0.10 | 16 |
| ..... | ................. | ................. | ....D. | ..TTGA..AY.D | A..A........ | 0.10 | 16 |
| TA... | F.....DGA.R..P.A.K | ..YN......F......T | R..DD. | ............ | A..A........ | 0.09 | 15 |
| ..... | ................K | .Q.DH....NF....... | ...DD. | E.AT.A.AEVDS | A..A........ | 0.09 | 15 |
| ST... | F.....NR..RE.I...G | T.PSE............ | ...... | ............ | A..A........ | 0.09 | 15 |
| TA... | ......STT.HA.L.T.K | ..YNH.....F....... | ....D. | .DAAGN..A..E | A..A........ | 0.09 | 15 |
| N.... | F.....GRT.ND.L.Q.R | T.PTG....DF....... | ...DDR | ............ | A..A........ | 0.09 | 15 |
| ..... | ................. | .........DF......T | ...TG. | ............ | A..A........ | 0.09 | 15 |
| ..... | ................. | ................. | ...D.. | E.AGANDA.AV.H | A..A........ | 0.09 | 15 |

TABLE 7-continued

AAV capsid proteins having increased specificity for and/or transduction of
CD44+ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | F................. | .V........F....... | ...... | ............ | GPKNP..DRT.D | 0.09 | 15 |
| ..... | ................. | ...............T | ...D.. | ............ | ............ | 0.09 | 15 |
| TA... | F.....SRA.SK.N.A.H | .QDT.....DF....... | ...DDR | ...G.S..AFGD | A..A........ | 0.09 | 15 |
| A.... | F.....SA..RA.....R | ..YN......F......T | ...D.. | ............ | A..A........ | 0.09 | 15 |
| R...T | ................. | .V........F....... | E..TD. | ............ | ............ | 0.09 | 15 |
| ST... | F.....NKG.N..K.G.G | .........NF....... | R...D. | ............ | A..A........ | 0.09 | 15 |
| ..... | ................. | ................. | ...DD. | E..T.G.TA.DH | A..A........ | 0.09 | 15 |
| ..... | F.....DA..IA.L.K.R | .KDSR............ | E..AD. | ............ | ............ | 0.09 | 15 |
| ..... | ................. | ................. | G..K.. | E.AGRDD..V.E | A..A........ | 0.09 | 15 |
| ..... | ................. | ................. | G..D.R | ............ | A..A........ | 0.09 | 15 |
| ..... | ................. | ................. | R..D.. | ESG.RAD..V.Q | A..A........ | 0.09 | 15 |
| ..... | ................. | ................. | ...DD. | EDGR.GD.E.GS | A..A........ | 0.09 | 15 |
| ..... | ................. | ..........F...... | R..TGR | ............ | A..A........ | 0.09 | 15 |
| ..... | ................. | ................. | R..DD. | ...ARS.A.FDG | A..A........ | 0.09 | 15 |
| DA... | F.......T.SV...H.R | ..DGE....DF....... | ...... | EN.G.SD..VDR | A..A........ | 0.09 | 15 |
| DT... | ................. | .Q.GQ....DF....... | ...ADR | ............ | A..A........ | 0.09 | 15 |
| ..... | F................ | ................. | R..DD. | ............ | ............ | 0.09 | 15 |
| ..... | F.....DRG.SL.M...I | ................. | ...NGR | ............ | A..A........ | 0.09 | 14 |
| ..... | F................ | .V........F....... | ...... | ............ | TRQS...FSM.. | 0.09 | 14 |
| ..... | ................. | ................. | ...D.. | ..TNE..I..DG | A..A........ | 0.09 | 14 |
| ..... | ................. | ................. | R..... | ..AAG..AA..R | A..A........ | 0.09 | 14 |
| ..... | ................. | .........DF......T | ...... | ..ANTN.TA.DS | A..A........ | 0.09 | 14 |
| E.... | F.....DS..NH.I.P.R | ..PNG....DF....... | ...NGR | ............ | A..A........ | 0.09 | 14 |
| ..... | ................. | ................. | R...D. | .SAG...TEYD. | A..A........ | 0.09 | 14 |
| ..... | ................. | .KYT.....NF..P...T | R..D.. | ............ | A..A........ | 0.09 | 14 |
| G.... | F.....AEG.LK.M.H.L | ....TE....F....... | ...DDR | ............ | A..A........ | 0.09 | 14 |
| EA... | F.....DAA.IK.T.Q.N | ..DGE....DF....... | ...... | E........... | ............ | 0.09 | 14 |
| ..... | ................. | ................. | G..TDR | E.AGGN..E.DD | ............ | 0.09 | 14 |
| ..... | F................ | .V........F....... | ...... | ............ | G.QTT..Y.G.E | 0.09 | 14 |
| ..... | ................. | .........DF...... | R...D.. | ..TAGA.AA.DN | A..A........ | 0.09 | 14 |
| G.... | F.....STA..Q.H.Q.L | .Q.DR.....F....... | ....D. | ............ | A..A........ | 0.09 | 14 |
| AT... | F.....AST.PI.K.Q.K | TQ.TH....DF....... | ...... | ............ | A..A........ | 0.09 | 14 |
| R.... | ......NKT.I....... | .........DF....... | ...D.R | .DANRN.A.VDH | A..A........ | 0.09 | 14 |
| ..... | F......GT.NM.L.Q.G | .Q.S......F....... | ....D. | ............ | ............ | 0.09 | 14 |
| ..... | ................. | ................. | ....D. | .DGKGS.IA..G | A..A........ | 0.09 | 14 |
| ..... | ................. | ................. | E..DGR | ............ | ............ | 0.09 | 14 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | ................ | .................... | ...DDR | ENTTGNDAE.GQ | A..A........ | 0.09 | 14 |
| D...T | F.....GRT.ND.L.Q.R | ..PNG....DF....... | G..NDR | E..GGG..EF.G | A..A........ | 0.09 | 14 |
| ..... | ................ | .................... | ...... | .DTAAA...VGE | A..A........ | 0.09 | 14 |
| ..... | F............... | .V........F...... | ...... | ............ | ERRTS....V.. | 0.09 | 14 |
| ..... | F............... | .V........F...... | ...... | ............ | DHRAT..SNN.D | 0.09 | 14 |
| ..... | F............... | .V........F...... | ...... | ............ | G.RG...SGA.. | 0.09 | 14 |
| ..... | ................ | ........DF....... | ...DDR | .NG..G.I...G | A..A........ | 0.08 | 13 |
| SA..T | F.....NET.NA.P...K | ..HG.....NF......T | ...A.. | ............ | A..A........ | 0.08 | 13 |
| G.... | ................ | .Q.S......F....... | ....D. | ............ | ............ | 0.08 | 13 |
| NT... | F.....ATG.NV.T.G.R | .Q.DR.....F....... | ....D. | EDAGT...AFD. | A..A........ | 0.08 | 13 |
| A.... | F.....NA..RL.T.P.G | T.P.......F....... | R..DD. | ............ | A..A........ | 0.08 | 13 |
| ..... | F............... | .V........F...... | ...... | ............ | DTRSG...R..A | 0.08 | 13 |
| ..... | ................ | .................... | ...DD. | E.TGAN.AE.GE | A..A........ | 0.08 | 13 |
| ..... | ................ | .................... | G..KGR | ..AAE..A.F.E | A..A........ | 0.08 | 13 |
| ..... | ................ | ........DF....... | ...D.R | E.GDEAD...DR | A..A........ | 0.08 | 13 |
| ..... | F............... | .V........F...... | ...... | ............ | NETRT..FHT.D | 0.08 | 13 |
| E.... | F.....AA...K.T.E.L | TQ.GG....NF....... | ...D.R | ............ | A..A........ | 0.08 | 13 |
| ..... | ................ | .................... | ...AG. | ..AARS..AF.. | A..A........ | 0.08 | 13 |
| T.... | ................ | ..PNG....DF....... | G..NDR | ............ | ............ | 0.08 | 13 |
| ..... | ................ | .................... | ...D.. | E.TGAN.AE.GE | A..A........ | 0.08 | 13 |
| A.... | ................ | TQ.TG....DF....... | ...... | ..ARAA.I..GQ | A..A........ | 0.08 | 13 |
| ..... | F............... | .V........F...... | ...... | ............ | GPRTP..FDI.A | 0.08 | 13 |
| .A... | F.....NQG....P.K.I | TK.NE....DF......T | ...... | ..AGAN..A.GD | A..A........ | 0.08 | 13 |
| ..... | ................ | .................... | R...D. | .D.NGA.TE.GD | A..A........ | 0.08 | 13 |
| ..... | ................ | .................... | R...DR | ES.GEG...VDS | A..A........ | 0.08 | 13 |
| G...T | F.....AHA.SH.M.S.R | ..DGE....DF....... | ...... | .SGGRS..E.DQ | A..A........ | 0.08 | 13 |
| ..... | F............... | .V........F...... | ...... | ............ | AR.G...IDV.H | 0.08 | 13 |
| ..... | ................ | .................... | ....GR | .SAKGG..EYGD | A..A........ | 0.08 | 13 |
| ..... | ................ | .................... | ...KD. | .DTA.N....DS | A..A........ | 0.08 | 13 |
| G.... | F.....DTA.PK...P.R | ..HG.....NF......T | ...AD. | E.AG.ADIE.G. | A..A........ | 0.08 | 13 |
| RT... | F.....ART..V.N.K.. | ..........F....... | G..AD. | ............ | A..A........ | 0.08 | 13 |
| ..... | F.....DAT.NL.H.Q.L | ..........F.....T | ...DG. | ............ | ............ | 0.08 | 13 |
| GA..T | F.....STG..N.M.Y.. | ..YN.....F.....T | ....D. | ............ | A..A........ | 0.08 | 13 |
| ..... | ................ | ........DF.....T | G..AD. | ESG..N.I..DG | A..A........ | 0.08 | 13 |
| A.... | F.....SA..RA.....R | TKPDR.....F....... | R..D.. | .SAGAN..E..S | A..A........ | 0.08 | 13 |
| TA..T | ................ | ..HG.....NF......T | ...TDR | .SA....AEVDD | A..A........ | 0.08 | 13 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| .A... | F.....ATT..N.L...L | ..ADG....DF....... | ...DDR | ............ | A..A........ | 0.08 | 13 |
| ..... | .................. | .PPNG.....F......T | ...DDR | E.TR.N.....Q | ............ | 0.08 | 13 |
| ..... | .................. | .................. | ...DDR | .STAAG...VDG | A..A........ | 0.08 | 13 |
| D...T | F.....SRA.SK.N.A.H | ..DGE....DF....... | ...... | ..AST..AA..D | A..A........ | 0.08 | 13 |
| ..... | F.....NDG.NH.L.A.R | TKPS.....DF......T | ...DDR | ............ | A..A........ | 0.08 | 13 |
| GA... | F.....STA..Q.H.Q.L | T.P......DF....... | R...D. | ............ | ............ | 0.08 | 13 |
| R.... | .................. | TQASG....DF....... | ...... | E.AG..D.A.GR | A..A........ | 0.08 | 13 |
| RA... | F.....DGA.R..P.A.K | .........NF....... | R...D. | ............ | A..A........ | 0.07 | 12 |
| E.... | .................. | .................. | ...... | ............ | ............ | 0.07 | 12 |
| ..... | .................. | .................. | R..TDR | .D.RA......S | A..A........ | 0.07 | 12 |
| RA... | .................. | ..AGR....DF......T | G..N.. | ............ | A..A........ | 0.07 | 12 |
| .A... | F.....DG..I..K.K.G | .QPSG....NF....... | E..TGR | ............ | ............ | 0.07 | 12 |
| TT..T | .................. | ..HG.....NF......T | E..DD. | ............ | A..A........ | 0.07 | 12 |
| GA... | F......DG.HV.M.A.R | .........DF....... | R..DD. | ............ | A..A........ | 0.07 | 12 |
| ..... | .................. | .................. | ...N.. | EDGKGA....GE | A..A........ | 0.07 | 12 |
| ..... | .................. | .................. | R...G. | EN.AGGD.E... | A..A........ | 0.07 | 12 |
| ..... | .................. | .................. | ...... | E.GGANDT...G | A..A........ | 0.07 | 12 |
| ..... | F.....SN..PL.K.T.. | .................. | G..DG. | ............ | ............ | 0.07 | 12 |
| RA... | F.....SG..IK.K.D.R | ..ADH....DF....... | E..AD. | .SADAG..A..S | A..A........ | 0.07 | 12 |
| ..... | F.....SN..PL.K.T.. | T.ADG...DF......T | ...D.. | ............ | ............ | 0.07 | 12 |
| ..... | .................. | .QANH.....F......T | ...DDR | .DTAGN...Y.R | A..A........ | 0.07 | 12 |
| ..... | .................. | .................. | ...AG. | ............ | A..A........ | 0.07 | 12 |
| ET..T | F.....ANG.HL.K.K.S | ..........F......T | ...D.. | ............ | A..A........ | 0.07 | 12 |
| ..... | .................. | ...TG....NF....... | R..AD. | EDAKGG.....R | A..A........ | 0.07 | 12 |
| ..... | .................. | .................. | ...DDR | .NGST.....GG | A..A........ | 0.07 | 12 |
| ..... | .................. | .........NF....... | G..TDR | .DGG.....Y.Q | A..A........ | 0.07 | 12 |
| ..... | .................. | .................. | R...DR | ............ | A..A........ | 0.07 | 12 |
| ..... | ......HK.P.N.G | .........NF....... | ...NDR | ............ | ............ | 0.07 | 12 |
| ..... | .................R | .................. | ...... | ..ATESD..FDQ | A..A........ | 0.07 | 12 |
| ..... | .................. | .................. | ....GR | ............ | A..A........ | 0.07 | 12 |
| TA..T | .................. | .PPNG.....F......T | ...DDR | ............ | A..A........ | 0.07 | 12 |
| ..... | F.....ANG.HL.K.K.S | .................. | G..N.. | ............ | A..A........ | 0.07 | 12 |
| SA... | F......TT.HN.L.G.R | ..DGE....DF....... | ...... | E.AKGG..A.DQ | A..A........ | 0.07 | 12 |
| ..... | F................. | .V.......F........ | ...... | ............ | GRHGT...K..A | 0.07 | 12 |
| ..... | .................. | .................. | G..DG. | ............ | ARSNR..FDV.H | 0.07 | 12 |
| ..... | F.....DGA.R..P.A.G | .........NF......T | R..... | .DA..N..A..E | A..A........ | 0.07 | 12 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| SA..T | F.....NAA.I..M.G.R | .Q.S......F....... | ...D.. | ........... | A..A........ | 0.07 | 12 |
| .A... | F.....DNA.NA.M.N.K | ..PNC....DF....... | G..NDR | ........... | A..A........ | 0.07 | 12 |
| ..... | F................. | .V........F....... | ...... | ........... | T.KGR...N..Q | 0.07 | 12 |
| ..... | ................. | ................. | ...A.. | ..AKGD.AEYDQ | A..A........ | 0.07 | 12 |
| N.... | F.....NTG.RN.T.T.L | ..DGE....DF....... | ...... | ........... | A..A........ | 0.07 | 12 |
| GA... | F.....GAT.RL.H.Q.E | .QPN......F......T | ...DD. | ........... | A..A........ | 0.07 | 12 |
| T.... | ................. | ................. | ...... | ........... | A..A........ | 0.07 | 12 |
| ..... | F.....AE...A.T...R | ................. | ...... | E.TGTA.AEVGE | A..A........ | 0.07 | 12 |
| ST... | F.....GR..HD.L.N.L | ..AGR.....F......T | ....D. | ........... | A..A........ | 0.07 | 12 |
| ST... | F.....SKA.S..L.E.R | .QPG.....NF....... | G..AG. | ........... | A..A........ | 0.07 | 12 |
| E.... | ................. | T.AG......F......T | ...DD | ..TKRDD.A.DE | A..A........ | 0.07 | 11 |
| ..... | F................. | .V........F....... | ...... | ........... | GRHAA..NDA.P | 0.07 | 11 |
| GT... | ................. | ................. | ...... | EN.TTG.IE.DR | A..A........ | 0.07 | 11 |
| RT... | F......S..PM.T.S.K | .Q.......DF....... | ...AD. | ........... | A..A........ | 0.07 | 11 |
| ..... | ................. | ................T | ...DDR | .SAKAA.AA.DE | A..A........ | 0.07 | 11 |
| TA... | ................. | .QPN......F......T | ...N.. | .DTAG.D.A.DG | A..A........ | 0.07 | 11 |
| NA... | F.....NRA..I.T...S | .KDDG....NF......T | ...DG. | ........... | A..A........ | 0.07 | 11 |
| ..... | F.....GGG.HN.H.T.M | ..HG.....NF......T | R...DR | .........D. | A..A........ | 0.07 | 11 |
| ..... | ................. | ................T | E..ND. | ........... | A..A........ | 0.07 | 11 |
| ..... | ................. | ................. | E..ND. | ........... | ........... | 0.07 | 11 |
| ..... | F................. | .V........F....... | ...... | ........... | GRSGR...EG.T | 0.07 | 11 |
| GT... | F.....GKA.SE.N...K | T.AG.....NF......T | ...N.. | ........... | A..A........ | 0.07 | 11 |
| ..... | ................. | ................. | R...GR | EDGDGA..A.DR | A..A........ | 0.07 | 11 |
| ..... | F.....GN..NK.P.P.N | TQPTE....DF....... | ...DDR | ........... | A..A........ | 0.07 | 11 |
| ..... | F.....NGG.NV.N.K.G | .QAS......F....... | ...... | E.AGGN..A.DG | A..A........ | 0.07 | 11 |
| .A... | F.....SKA.S..L.E.R | ................. | ...D.. | ........... | A..A........ | 0.07 | 11 |
| SA... | ................. | ..HG.....NF......T | ...A.. | ........... | A..A........ | 0.07 | 11 |
| D.... | F.....S.T.NV.L.D.. | .........NF....... | R...D. | ........... | A..A........ | 0.07 | 11 |
| DA... | F......RT.LA.L.G.K | TQ.TG....DF....... | ...DDR | ........... | A..A........ | 0.07 | 11 |
| GT... | F.....AGA.LQ.T.E.R | .PPNG.....F......T | ....GR | E.AG..D.A.GR | A..A........ | 0.07 | 11 |
| DA..T | F.....STA..Q.H.Q.L | ................. | ...A.. | .N.KA.DAE..D | A..A........ | 0.07 | 11 |
| ..... | ................. | ................. | ...... | ..GGTD....DR | A..A........ | 0.07 | 11 |
| ..... | F................. | .V........F....... | ...... | ........... | GPRTG...HT.E | 0.07 | 11 |
| ..... | F................. | .V........F....... | ...... | ........... | .P.T...AHG.H | 0.07 | 11 |
| ..... | ................. | ................. | E..KD. | .S.TAA.TEFDE | A..A........ | 0.07 | 11 |
| ..... | ................. | ................. | G..DD. | ........... | A..A........ | 0.07 | 11 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| D...T | F.....AN..SI.L.H.R | .........NF....... | R...D. | E.TA.S..EY.. | A..A........ | 0.07 | 11 |
| NT..T | F.....AA..IQ.T.K.R | TQ.TG....DF....... | ...DDR | ..AGRADI...S | A..A........ | 0.07 | 11 |
| ..... | ................. | ................. | ...KG. | | A..A........ | 0.07 | 11 |
| ..... | ................. | ................. | ....D. | ESAGRSDTA.DE | ............ | 0.07 | 11 |
| D...T | F.....STA..Q.H.Q.L | ..YN......F......T | ...D.. | | A..A........ | 0.07 | 11 |
| G.... | F.....A...ND.T...K | .QPN......F......T | ...ADR | .D.GRA...F.. | A..A........ | 0.07 | 11 |
| D...T | F.....DGA.RN.T.S.G | ..HG.....NF....... | ...D.. | | A..A........ | 0.07 | 11 |
| AA... | F.....NKG.IP.N.H.R | .QDT.....DF....... | G..DG. | ..GGG.D.E... | A..A........ | 0.07 | 11 |
| ..... | ................. | .V........F....... | E..TD. | | ............ | 0.07 | 11 |
| ..... | ................. | ................. | ....... | | GRKNA..FQN.E | 0.07 | 11 |
| ..... | F......S..PM.T.S.K | ................. | ...D.. | | A..A........ | 0.07 | 11 |
| ..... | ................. | ................. | ....D. | ENAS.N.AEYDR | A..A........ | 0.07 | 11 |
| DT... | F......N..IL.T.T.R | .QPSQ....NF....... | G...GR | | A..A........ | 0.07 | 11 |
| ..... | ................. | ................. | ...DDR | | ............ | 0.07 | 11 |
| ..... | ................. | .QP.G.....F......T | ...DDR | | A..A........ | 0.07 | 11 |
| ..... | F................. | .V........F....... | ...... | | TPRAR..DNI.D | 0.07 | 11 |
| DT... | ................. | ..DGE....DF....... | ...... | | ............ | 0.07 | 11 |
| ..... | ................. | ................. | ...DDR | EDGSR...E.GE | A..A........ | 0.07 | 11 |
| ..... | F................. | .V........F....... | ...... | | GARA...ISG.Q | 0.07 | 11 |
| E.... | ................. | ................. | ...... | | A..A........ | 0.07 | 11 |
| ..... | ................. | ................. | ...ADR | .SGGA.....DG | A..A........ | 0.07 | 11 |
| RT... | F.....SA..RA.....F | .KDT......F......T | ...DD. | EN.D.A..EVDD | A..A........ | 0.07 | 11 |
| ..... | ................. | ................. | ....GR | ..AGA..AA.GS | A..A........ | 0.07 | 11 |
| ..... | F................. | .V........F....... | ...... | | GTRST..FRE.T | 0.07 | 11 |
| GT... | F.....GG..SL.L...B | ..DGE....DF....... | ...... | ES.DRN.....Q | A..A........ | 0.06 | 10 |
| ..... | F................. | .V........F....... | ...... | | ARRDA..NR..T | 0.06 | 10 |
| S.... | ................. | TKA......NF....... | ...... | ESAK..D.E..N | A..A........ | 0.06 | 10 |
| ..... | F................. | .V........F....... | ...... | | ADKTA..VKG.Q | 0.06 | 10 |
| ..... | F................. | .V........F....... | ...... | | KRQAG...HE.A | 0.06 | 10 |
| NT... | F.....AT..SM.L.H.R | .V........F......T | ...A.. | | A..A........ | 0.06 | 10 |
| GT... | ................. | ................. | ...DG. | | A..A........ | 0.06 | 10 |
| ..... | ................. | ..YN......F......T | ...D.R | EDGKGN..AF.. | A..A........ | 0.06 | 10 |
| ..... | F................. | .V........F....... | ...... | | DKQTS..FRG.Q | 0.06 | 10 |
| ..... | F................. | .V........F....... | ...... | | GNRNN...TN.T | 0.06 | 10 |
| TT... | F.....GRG.H..P.E.M | ..DGE...DF....... | ...... | ..AG.N.AA.GQ | A..A........ | 0.06 | 10 |
| ..... | F................. | .V................ | R..DD. | | THRDT..FRM.T | 0.06 | 10 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ..... | ................ | ................ | R...D. | ..AAG..AA..R | A..A........ | 0.06 | 10 |
| TT... | F.....GGT.IV.K.G.K | .Q.DR....DF....... | ...DDR | ............ | GQKDR..ST..H | 0.06 | 10 |
| ..... | ................ | ................ | E..TD. | ............ | A..A........ | 0.06 | 10 |
| ..... | ................ | ........NF....... | E..ND. | ES.GAN..EVDG | A..A........ | 0.06 | 10 |
| NA... | F.....DSG.RV.P.G.H | ..P.E....NF......T | R..TGR | E.AG.S..E.DN | A..A........ | 0.06 | 10 |
| A.... | F................ | .V........F...... | ...... | ............ | TASSA..Y.A.. | 0.06 | 10 |
| ..... | ................ | ........DF....... | ...... | .DAAGS.AAVD. | A..A........ | 0.06 | 10 |
| TA... | F................ | .V........F...... | ...... | ............ | A..A........ | 0.06 | 10 |
| TA... | F................ | .V........F...... | ...... | ............ | ERRTH...TE.. | 0.06 | 10 |
| ..... | ................ | TQ.TG....DF....... | ...DDR | ............ | A..A........ | 0.06 | 10 |
| ..... | ................ | ................ | ....GR | ..ARRGD.A.DE | A..A........ | 0.06 | 10 |
| ..... | F................ | .V........F...... | ...... | ............ | A.RAG..VR..H | 0.06 | 10 |
| ..... | F.....DEA.RQ.T.N.L | .........NF....... | R...D. | ..ASE...E.D. | A..A........ | 0.06 | 10 |
| ..... | ................ | ................ | ...... | E.AG.A.T.V.N | A..A........ | 0.06 | 10 |
| ..... | F................ | .V........F...... | ...... | ............ | THRDA...EG.E | 0.06 | 10 |
| ..... | ................ | ................ | ...DDR | ENGGGSDAE.DD | A..A........ | 0.06 | 10 |
| .A... | F.....NAG.P..T.T.M | .........DF....... | ...DDR | ..AGAS...FDR | ............ | 0.06 | 10 |
| ..... | ................ | ................ | R..A.. | ............ | A..A........ | 0.06 | 10 |
| NA... | ................ | .V........F...... | ...... | ESTARN.A.V.Q | A..A........ | 0.06 | 10 |
| .A... | ................ | ..A......DF....... | ...DG. | EN.G.A.....Q | A..A........ | 0.06 | 10 |
| ..... | ................ | ................ | ....G. | ..ATGSD.A..H | A..A........ | 0.06 | 10 |
| ..... | ................ | ................ | ...DDR | .DAKGN..EVGQ | A..A........ | 0.06 | 10 |
| ..... | ................ | ................ | ...DDR | .STTEA....GQ | A..A........ | 0.06 | 10 |
| ..... | ................ | ................ | ...... | EDGTA..IE..E | A..A........ | 0.06 | 10 |
| SA..T | ................ | .QPG.....NF....... | ...DDR | .DTRTG.A..GG | A........... | 0.06 | 10 |
| .A... | F.....DRG.S..T.A.S | ..DGE....DF....... | ...... | ............ | A..A........ | 0.06 | 10 |
| NA... | ................ | ................ | E..NG. | ............ | ............ | 0.06 | 10 |
| ..... | F................ | .V........F...... | ...... | ............ | AK.TE...G... | 0.06 | 10 |
| ..... | F.....ASA.S..T.T.G | .QPG.....DF....... | ...DDR | ............ | A..A........ | 0.06 | 10 |
| ..... | F................ | .V........F...... | ...... | ............ | GNRGN....... | 0.06 | 10 |
| RA... | ................ | .KYT.....NF......T | R..DD. | E.TGAN.AE.GE | A..A........ | 0.06 | 10 |
| AA... | F.....GRG.SP.K...G | .QPG.....NF....... | ...DDR | ............ | DRRSA..YTT.Q | 0.06 | 10 |
| ..... | F................ | .V........F...... | ...... | ............ | THRAA..SR... | 0.06 | 10 |
| ..... | ................ | ................ | R..DD. | E.TS.D..AFDQ | A..A........ | 0.06 | 10 |
| ..... | F................ | .V........F...... | ...... | ............ | G..T...VRM.T | 0.06 | 10 |
| G.... | ................ | .QHNQ.....F......T | G..NDR | ..TGAS..EV.N | A..A........ | 0.06 | 10 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | F................. | .V........F....... | ...... | ............ | DQRGT...RG.D | 0.06 | 10 |
| ..... | ................. | TKDDR....DF........ | ...DGR | ESAGAN.AE.CE | A..A........ | 0.06 | 10 |
| .A... | F................. | .........DF....... | ...DDR | ..AGAS...FDR | ............ | 0.06 | 10 |
| R.... | ................. | TKDDR....DF....... | ...DDR | ............ | A..A........ | 0.06 | 10 |
| GT... | ................. | TQ.TG....DF....... | ...DDR | .SADAG..A..S | A..A........ | 0.06 | 10 |
| TA... | F.....GGG.LD.T...R | .Q.S......F....... | E..N.. | ............ | A..A........ | 0.06 | 10 |
| ..... | ................. | .........DF....... | ...A.. | ..AN.A..AV.G | A..A........ | 0.06 | 10 |
| A.... | F.....AEG.NI.L.K.R | TPPSQ....NF......T | R..AGR | ............ | A..A........ | 0.06 | 10 |
| ..... | F.....AEG.LK.M.H.L | ..DGE....DF....... | ...... | ............ | A..A........ | 0.06 | 10 |
| ..... | ................. | ..HG.............. | ...AG. | ............ | A..A........ | 0.06 | 10 |
| ..... | F................. | .V........F....... | ...... | ............ | GERTP..ART.D | 0.06 | 10 |
| ..... | F................. | .V........F....... | ...... | ............ | TRRD...N.S.P | 0.06 | 10 |
| ..... | F................. | .V........F....... | ...... | ............ | AASAG..YNN.A | 0.05 | 9 |
| ....T | F.....GRT.ND.L.Q.R | T..NE....DF......T | ...DD. | ............ | A..A........ | 0.05 | 9 |
| GA... | F.....DQ..R..P.S.R | ..DGE....DF....... | ...... | .N.ARS..E.GQ | A..A........ | 0.05 | 9 |
| ..... | ................. | .................. | E..AD. | ............ | A..A........ | 0.05 | 9 |
| ..... | F................. | .V........F....... | ...... | ............ | GTRSP..S.N.D | 0.05 | 9 |
| ..... | ................. | .................. | ...D.. | E.GGEG..E.DG | A..A........ | 0.05 | 9 |
| ..... | ................. | ..HGH....NF......T | ...D.. | ............ | A..A........ | 0.05 | 9 |
| ..... | ................. | .........DF....... | ...D.. | .S.KA..TE.DS | A..A........ | 0.05 | 9 |
| ..... | ................. | .QD.E.....F..P.... | E..N.. | ............ | A..A........ | 0.05 | 9 |
| ..... | ................. | .................. | ...DDR | ESGTA.D..VDR | A..A........ | 0.05 | 9 |
| T.... | F.....DDG.LA.K...R | .................. | ...... | ............ | A..A........ | 0.05 | 9 |
| ..... | ................. | .................. | R..N.. | .D.TGN.I...Q | A..A........ | 0.05 | 9 |
| DT..T | F................. | .V........F....... | ...... | ............ | SNST...YHV.E | 0.05 | 9 |
| ..... | ................. | ..A......DF....... | ...A.. | ESAGRN.IE.GG | A..A........ | 0.05 | 9 |
| ..... | ................. | .................. | ...D.R | EDGATG...VDR | A..A........ | 0.05 | 9 |
| ..... | ................. | .................. | E..ND. | E.AGGND....R | A..A........ | 0.05 | 9 |
| ..... | F................. | .V........F....... | ...... | ............ | GNRAP..IS..E | 0.05 | 9 |
| ..... | F................. | .V........F....... | ...... | ............ | GRRDN..YRT.T | 0.05 | 9 |
| AT... | ................. | .................. | ...DD. | ..GNGN..E..S | A..A........ | 0.05 | 9 |
| ..... | ................. | .................. | ...... | .D.N.A...VGE | A..A........ | 0.05 | 9 |
| .A... | F................. | .................. | ...D.. | ............ | A..A........ | 0.05 | 9 |
| ..... | ................. | .................. | R..ADR | ..ADA..TEVDS | A..A........ | 0.05 | 9 |
| D.... | F.....SRT..A...T.N | T.P......DF....... | ...D.. | ............ | ............ | 0.05 | 9 |
| AA... | F.....GRG.SP.K...G | .QPG.....NF....... | ...DDR | ............ | A..A........ | 0.05 | 9 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | ................. | ................... | R..... | E.GTEGDA.... | A..A........ | 0.05 | 9 |
| EA... | F.....DH..ID.K...V | ................... | ...... | ..AG.DD...GG | A..A........ | 0.05 | 9 |
| ..... | ................. | ................... | ...D.. | ESGAAA..EV.Q | A..A........ | 0.05 | 9 |
| ..... | ................. | ................... | R..DG. | .SGKRA..E.DQ | A..A........ | 0.05 | 9 |
| H.... | ................. | .Q.S......F...... | E..NG. | ............ | ............ | 0.05 | 9 |
| G.... | ................. | ................... | G..KD. | ............ | A..A........ | 0.05 | 9 |
| .T..T | ................. | ..AGR.....F......T | R..D.. | ............ | A..A........ | 0.05 | 9 |
| ..... | ................. | ................... | ...DD. | ...RTD..A..H | A..A........ | 0.05 | 9 |
| ..... | ................. | ................... | ...DGR | E.ADGA..AYDR | A..A........ | 0.05 | 9 |
| A.... | ................. | TKDDR....DF...... | ...DDR | ............ | ............ | 0.05 | 9 |
| ..... | ................. | ................... | ...KD. | ............ | A..A........ | 0.05 | 9 |
| ..... | ................. | ................... | ...D.. | .DAGRG..AYDH | A..A........ | 0.05 | 9 |
| ..... | ................. | ................... | ...NGR | EDAT.D.A..D. | A..A........ | 0.05 | 9 |
| ..... | ................. | ....E...DF...... | ...... | E.GTEGDIA..D | A.KA........ | 0.05 | 9 |
| ..... | ................. | ..YG......F.....T | E..DD. | ............ | A..A........ | 0.05 | 9 |
| ..... | ................. | ................... | ...AG. | ESTTEA...... | A..A........ | 0.05 | 9 |
| ..... | ................. | TKDDR....DF...... | ...DDR | ............ | A..A........ | 0.05 | 9 |
| EA... | F.....SN..PL.K.T.. | .Q.DR.....F...... | ....D. | ...NRAD.E..Q | A..A........ | 0.05 | 9 |
| ..... | F................G | ..PDG.....F...... | E..N.. | ............ | A..A........ | 0.05 | 9 |
| ..... | ..........K.L...G | ................T | G..DD. | ESAA.D..E.GD | A..A........ | 0.05 | 9 |
| ..... | ................. | TK.G.....DF...... | ...D.. | ..GTA.D.EFD. | A..A........ | 0.05 | 9 |
| ..... | ................. | ................... | ...... | .DAKG..I.FDG | A..A........ | 0.05 | 9 |
| ..... | ................. | ................... | ...DDR | ..ATGS..EYGS | A..A........ | 0.05 | 9 |
| ..... | ................. | ................... | ...D.R | ..ARTADTE.DS | A..A........ | 0.05 | 9 |
| A.... | F.....SA..RA.....F | ................... | ...... | ............ | A..A........ | 0.05 | 9 |
| ..... | ................. | ................... | ...DDR | .STAES.IH.DG | A..A........ | 0.05 | 9 |
| ..... | ................. | ................... | ...D.R | EDAGRGD...GN | A..A........ | 0.05 | 9 |
| DA... | F................ | .V........F...... | ...... | ............ | TRRDP..DNM.T | 0.05 | 9 |
| ..... | ................. | ................... | ...DDR | E..GRD..AVDG | A..A........ | 0.05 | 9 |
| E.... | F................ | .V........F...... | ...... | ............ | NKQNG..NHE.T | 0.05 | 9 |
| N.... | ................. | ................... | ...DDR | ENTTGNDAE.GQ | A..A........ | 0.05 | 9 |
| TA... | F.....AEG.LK.M.H.L | ..DGE....DF...... | ...... | ............ | A..A........ | 0.05 | 9 |
| ..... | ................. | ................... | ....D. | ..ATESD..FDQ | A..A........ | 0.05 | 9 |
| GT... | F.....SD..I..H.D.R | ................... | ...... | ............ | ............ | 0.05 | 9 |
| DA... | F.....GNG.HV.H.G.R | ........DF...... | ...... | ............ | ............ | 0.05 | 9 |
| DT... | F.....SAG..L.P.H.S | ..YN......F......T | ...D.. | ............ | A..A........ | 0.05 | 9 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| E.... | F.....GAT.IN.M.K.L | ..DGE....DF....... | ...N.. | .......... | A..A........ | 0.05 | 9 |
| GT..T | F................. | .V........F....... | ...... | .......... | NPRNN..AR..H | 0.05 | 9 |
| ..... | .................. | .........DF....... | G..DD. | ED.NGN.IA.D. | A..A........ | 0.05 | 9 |
| ..... | .................. | ...............T | G..ND. | ESAGAN....GG | A..A........ | 0.05 | 9 |
| RA... | ......AST.IN.L.T.. | ..DGE....DF....... | ...... | .......... | ............ | 0.05 | 9 |
| ..... | .................. | .V........F....... | ...... | EDATRS..E..G | A..A........ | 0.05 | 9 |
| ..... | .................. | .QPG.....NF.....T | ...... | .......... | GRHAA..NDA.P | 0.05 | 9 |
| ..... | .................. | ................. | R..DD. | E..KT.D.A..D | A..A........ | 0.05 | 9 |
| .A... | .................. | ................. | ...DDR | .......... | ............ | 0.05 | 9 |
| ..... | .................. | ...............T | ...DDR | .SAS.N.IA..E | A..A........ | 0.05 | 9 |
| ..... | .................. | ................. | R..D.. | E.AGG.DI..GH | A..A........ | 0.05 | 9 |
| ..... | .................. | ................. | ....D. | ...DGSDT..GG | A..A........ | 0.05 | 9 |
| ..... | .................. | ................. | E..DDR | E.AGG.D.E.DG | A..A........ | 0.05 | 9 |
| ..... | .................. | ................. | ...AG. | EDAAR.D.A.D. | A..A........ | 0.05 | 9 |
| TA... | F.....GDG.RH.L.K.G | .Q.DR....DF....... | R...D. | .......... | .......... | 0.05 | 9 |
| ..... | .................. | .V........F....... | R..AD. | .......... | A..A........ | 0.05 | 8 |
| NA..T | F.....NKG.N..K.G.S | ..DSH....DF.....T | ...D.. | .......... | A..A........ | 0.05 | 8 |
| ..... | .................. | ................. | E..DDR | .NA.AS.A..DR | A..A........ | 0.05 | 8 |
| ..... | .................. | ................. | ...... | .......... | DHRAR..FG... | 0.05 | 8 |
| ..... | F................. | .V........F....... | ...... | .......... | GPRT....RV.D | 0.05 | 8 |
| ..... | F................. | .V........F....... | ...... | .......... | AARDG...TV.H | 0.05 | 8 |
| ..... | F................. | ................R | ...ADR | E.GTEGDIA..D | A..A........ | 0.05 | 8 |
| ET..T | F.....STA..Q.H.Q.G | .........NF....... | R...D. | .......... | A..A........ | 0.05 | 8 |
| ..... | .................. | ................. | R..A.. | E.ATRA.IE.DD | A..A........ | 0.05 | 8 |
| ..... | .................. | ................. | T..DD. | ..ASE...E.D. | A..A........ | 0.05 | 8 |
| GA..T | F......AG.NP.P.D.R | .QAS.....NF.....T | ...... | .......... | A..A........ | 0.05 | 8 |
| DT... | F.....AR..SL...H.G | ..HG.....NF.....T | ...A.. | .......... | A..A........ | 0.05 | 8 |
| ..... | F................. | ................. | ...D.. | ..ASES.I..DG | A..A........ | 0.05 | 8 |
| GA..T | F......QG.NQ...A.R | .KYT.....NF.....T | ...D.. | .......... | A..A........ | 0.05 | 8 |
| S.... | .................. | ................. | R..... | EN.NES.T..DG | A..A........ | 0.05 | 8 |
| ..... | .................. | ..PN.....NF....... | ....G. | .N.TA.DAA.GD | A..A........ | 0.05 | 8 |
| ..... | .................. | ................. | ...... | E.AGG.D.E.DS | A..A........ | 0.05 | 8 |
| .A..T | F.....GKG.RK.L.N.E | ...GG.....F.....T | ...D.. | .......... | A..A........ | 0.05 | 8 |
| G.... | .................. | ..........F.....T | R..N.. | ENAAEG.I..DR | A..A........ | 0.05 | 8 |
| .T... | .................. | ...............T | ...... | .NAAAN..EF.H | A..A........ | 0.05 | 8 |
| TA... | F.....GS..NM.N.T.R | .QPN......F.....T | ....D. | E.TG.D.IAF.Q | A..A........ | 0.05 | 8 |

TABLE 7-continued

AAV capsid proteins having increased specificity for and/or transduction of CD44$^+$ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ..... | ................. | ................. | ...... | E..R.N.AEFGE | A..A........ | 0.05 | 8 |
| ..... | F................ | ................. | R...DR | .DA.TSD..VDR | A..A........ | 0.05 | 8 |
| ET... | F......QT..M.T...R | .KDT......F......T | ...DD. | E....ND.EF.Q | A..A........ | 0.05 | 8 |
| NA..T | ................. | .........DF....... | ...AD. | ............ | A..A........ | 0.05 | 8 |
| ..... | ................. | ..........F...... | ...... | ............ | A.SDT...R..A | 0.05 | 8 |
| ..... | ................. | ................. | ...DDR | .DAGTA...FGG | A..A........ | 0.05 | 8 |
| ..... | ................. | ..HG.....NF...... | E..DD. | ............ | ............ | 0.05 | 8 |
| ..... | ................. | ................. | ...D.. | .SAGRGDAAVDE | A..A........ | 0.05 | 8 |
| ..... | F......GA.NM.T.A.R | ..DGE....DF...... | ...... | E.AAAD.I..GQ | A..A........ | 0.05 | 8 |
| ..... | ................. | ................. | ...DDR | E.AGGN.TE..G | A..A........ | 0.05 | 8 |
| ..... | F................ | .V.......F...... | ...... | .SA.GG....DG | A..A........ | 0.05 | 8 |
| ..... | ................. | ................. | G..N.. | ............ | A..A........ | 0.05 | 8 |
| ..... | F................ | .V.......F...... | ...... | ............ | ADRTA..AH..H | 0.05 | 8 |
| ..... | ................. | ................T | ....D. | E.TGRA..A..G | A..A........ | 0.05 | 8 |
| ..... | F................ | .V.......F...... | ...... | ............ | G.RDE..DRT.. | 0.05 | 8 |
| ..... | ................. | ................. | ...D.R | .DAGES..AF.Q | A..A........ | 0.05 | 8 |
| ..... | ................. | .QANH.....F......T | R..A.. | E..A.ADA..GD | A..A........ | 0.05 | 8 |
| ..... | ................. | ................. | ....D. | ED.R.S.A...G | A..A........ | 0.05 | 8 |
| .A..T | F.......I | ..........F...... | R..DG. | ..ATESD..FDQ | A..A........ | 0.05 | 8 |
| ..... | ................. | ................. | ....D. | ..TD.N...VGQ | A..A........ | 0.05 | 8 |
| ..... | F................ | .V.......F...... | ...... | ............ | THRTT..F.E.T | 0.05 | 8 |
| NT... | F................ | ..........F...... | ...... | EN.RGNDIEF.D | A..A........ | 0.05 | 8 |
| DT... | F.....AEG.SV.P.G.S | .QPG.....NF......T | ...DDR | ............ | A..A........ | 0.05 | 8 |
| ..... | F.....DRG.SL.M...I | ................. | ...... | ............ | ............ | 0.05 | 8 |
| ..... | ................. | ................. | ....DR | ENAAA...A..G | A..A........ | 0.05 | 8 |
| ..... | ................. | ................. | ...AG. | ............ | A..A........ | 0.05 | 8 |
| GT... | F.....ARG.HP.L.Q.K | ...DG....NF...... | ...DDR | ............ | A..A........ | 0.05 | 8 |
| D.... | ................. | .KYT.....NF......T | R..NG. | ............ | A..A........ | 0.05 | 8 |
| ..... | F.....SK..LD.L.T.G | .Q.......DF...... | ...AD. | ............ | A..A........ | 0.05 | 8 |
| .A... | F......GT.NM.L.Q.G | .Q.S......F...... | ...... | ............ | ............ | 0.05 | 8 |
| ..... | ................. | ................. | ...A.. | ............ | A..A........ | 0.05 | 8 |
| G.... | ................. | .QHNQ.....F......T | ...N.. | ............ | A..A........ | 0.05 | 8 |
| ..... | ................. | ................. | ...DDR | ..TGAS..EV.N | A..A........ | 0.05 | 8 |
| .T... | F.....SRG.SP.T...G | .........NF...... | R...D. | .SAKAA.AA.DE | A..A........ | 0.05 | 8 |
| .T... | F.....G...LL.L.G.K | T.P......DF...... | ...D.. | EN.KAGDA..GE | A..A........ | 0.05 | 8 |
| ..... | F.....STA..Q.H.Q.G | ................. | R...D. | ............ | A..A........ | 0.05 | 8 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| GT... | F.....SGA..N...G.R | .Q.......DF....... | ...AD. | .NAAEND...GE | A..A........ | 0.05 | 8 |
| NA... | ................. | ................. | ...... | .DAKG..I.FDG | A..A........ | 0.05 | 8 |
| .T... | F.....AAT.N..P.P.R | TQADR....NF......T | R...D. | ............ | A..A........ | 0.05 | 8 |
| ..... | F.....DH..ID.K...V | T.PGG....NF....... | ...DD. | ESGGGN.IA.DQ | A..A........ | 0.05 | 8 |
| A...T | F.....GRA..L.K.A.S | .QAS......F....... | ...... | ENTGEA....G. | A..A........ | 0.05 | 8 |
| TA... | F.....GG..NK.M.... | ..A......DF....... | ...DG. | ..GT.N..A.DE | A..A........ | 0.05 | 8 |
| ..... | F................. | .PPNG.....F......T | ...DDR | E.TR.N.....Q | ............ | 0.05 | 8 |
| ..... | ................. | ................T | ....GR | ..TGAS..EV.N | A..A...... | 0.05 | 8 |
| GT... | F.....SA..RA.....R | ...DG....DF....... | R..TDR | ..A.AN..AV.Q | A..A........ | 0.05 | 8 |
| AT... | F.....GRG.SP.K...G | T.P......DF....... | ...... | EN.G.A.....Q | A..A........ | 0.05 | 8 |
| ..... | F.....STA..Q.H.Q.L | ..DGE....DF....... | ...... | ............ | A..A........ | 0.05 | 8 |
| ..... | F................. | .V........F....... | ...... | ............ | GHRGT..VTE.T | 0.05 | 8 |
| H.... | F.....SGA..N...G.R | .PANG.....F....... | ...DDR | E.ANGG.A...D | A..A........ | 0.05 | 8 |
| ..... | ................. | .V.......NF....... | E..AD. | ..GGA.D.E.GN | A..A........ | 0.04 | 7 |
| GT... | F................. | ................. | G..DG. | ............ | ............ | 0.04 | 7 |
| ..... | ......GRG.H..P.E.R | ..PNG...RDF....... | G..NDR | ............ | A..A........ | 0.04 | 7 |
| ..... | ................. | .V................ | ...... | ............ | .PRDG..SNV.A | 0.04 | 7 |
| GA... | F.....SAA.NM.M.A.L | TQP.R....DF....... | ...DDR | ............ | A..A........ | 0.04 | 7 |
| E.... | F.....ASA.S..T.T.G | .Q.DH....NF....... | ...DD. | ............ | A..A........ | 0.04 | 7 |
| ..... | ......D.G.IN.L.P.K | .QPG.....DF....... | ...DDR | ............ | A..A........ | 0.04 | 7 |
| ..... | ................. | ................. | R..A.. | .S.G.S.IA..G | A..A........ | 0.04 | 7 |
| E.... | F.....AA..IQ.T.K.R | .QAS......F....... | ...... | E.AARSD...GS | A..A........ | 0.04 | 7 |
| ..... | ................. | ................. | ...... | ESG.GN..EVDR | A..A........ | 0.04 | 7 |
| ..... | ................. | ................. | ...N.. | ..TG.A.I..D. | A..A........ | 0.04 | 7 |
| TT... | F.....DRG.SD.K.K.. | ..DNH....DF....... | ...ADR | ............ | A..A........ | 0.04 | 7 |
| ..... | F.....DRG.SL.M...I | ................. | ...... | .SAKAA.AA.DE | A..A........ | 0.04 | 7 |
| ..... | ................. | ................. | ...D.. | E.TAE..I.... | A..A........ | 0.04 | 7 |
| G.... | ................. | ................. | ...... | .SARG..A..DE | A..A........ | 0.04 | 7 |
| GT... | ................. | TQDT.....DF..P.... | R..DD. | ............ | A..A........ | 0.04 | 7 |
| T.... | G.....GS..NK.M.A.T | .QPSR.....F....... | ...... | ESAAG.D.AF.S | A..A........ | 0.04 | 7 |
| NA... | F......S..PM.T.S.K | ..DGE....DF....... | ...... | .S.SGN.IE..D | A..A........ | 0.04 | 7 |
| G.... | ................. | .QPTG....NF....... | E..AGR | ............ | A..A........ | 0.04 | 7 |
| ..... | ................. | ................. | ...AD. | E.AAGA.IA.GD | A..A........ | 0.04 | 7 |
| DA... | F.....DTG.SK.T.T.R | .QPTG.....F....... | ...NGR | ............ | A..A........ | 0.04 | 7 |
| ..... | F................. | .V........F....... | ...... | ............ | DSRGG..FSE.. | 0.04 | 7 |
| ..... | ................. | .........NF......T | G..DD. | E.ANGG.A...D | A..A........ | 0.04 | 7 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ET..T | F.....SG..IQ.M.Q.T | .KPDQ.....F....... | R..... | ............ | A..A........ | 0.04 | 7 |
| GA... | F.....GQ..LN.L.D.R | .Q.GQ....DF....... | ....GR | ............ | A..A....... | 0.04 | 7 |
| ..... | ................. | ................. | R..DD. | ...TG..T..GQ | A..A........ | 0.04 | 7 |
| ..... | ................. | ................. | ...AGR | .N.NRN.....G | A..A........ | 0.04 | 7 |
| ..... | F.....DAA.IK.T.Q.N | ..DGE....DF....... | ...... | E........... | ............ | 0.04 | 7 |
| TT..T | F......EA.SL.K.Q.R | ..DDG...DF....... | ...DDR | ............ | ............ | 0.04 | 7 |
| ..... | F................. | .V........F....... | ...... | ............ | GAKSG..Y.N.. | 0.04 | 7 |
| A.... | ................. | .QPN......F......T | ...N.. | E.AGAND.AV.H | A..A........ | 0.04 | 7 |
| ..... | ................. | ................. | ....D. | .SAAGAD.A.DS | A..A........ | 0.04 | 7 |
| ..... | ................. | ..HG.....NF......T | ..A... | ............ | A..A........ | 0.04 | 7 |
| D...T | F.....GSA.RV.L.A.R | ................. | ...D.R | E.TR.N...... | A..A........ | 0.04 | 7 |
| NA..T | ................. | ..HG.....NF......T | ...A.. | EDAG.AD.E.G. | A..A........ | 0.04 | 7 |
| SA... | ................. | ................. | E..N.. | ..ATAAD.E.DG | A..A........ | 0.04 | 7 |
| ..... | F.....DQ..R..P.S.R | .Q.DR.....F....... | ....D. | ............ | A..A........ | 0.04 | 7 |
| ..... | F................. | .V........F....... | R..ND. | ..AG...IAYGN | A..A........ | 0.04 | 7 |
| ..... | ................. | ................. | R..DD. | ..AGAD...FDG | A..A........ | 0.04 | 7 |
| HA... | F.....GKG.ND.T.N.G | ..A......DF....... | ...DG. | ............ | ............ | 0.04 | 7 |
| ..... | F................. | .V........F....... | ...... | ............ | GAHAN..DGM.A | 0.04 | 7 |
| ..... | ................. | ................. | ....D. | ..TGAS..EV.N | A..A........ | 0.04 | 7 |
| G.... | ................. | TQTPH....NF....... | R..DD. | E.AGGN...FGE | A..A........ | 0.04 | 7 |
| ..... | ................. | ................. | G..ND. | ED.A.G.T..DN | A..A........ | 0.04 | 7 |
| ..... | ................. | ..........F....... | ...NGR | .DAG.S.A..DR | A..A........ | 0.04 | 7 |
| ..... | F................. | .V.......F....... | ...... | ............ | ATKDG..SRA.Q | 0.04 | 7 |
| ..... | F................. | ................. | R..TGR | ............ | A..A........ | 0.04 | 7 |
| ..... | ................. | ................. | ...D.. | E.GTEGDA..D. | A..A........ | 0.04 | 7 |
| A...T | ................. | TQDS.....NF....... | ...A.. | E.AGTNDI.... | A..A........ | 0.04 | 7 |
| ....T | ................. | ..PN.....NF....... | R...D. | ESTGGND.EYDQ | A..A........ | 0.04 | 7 |
| RT... | ................. | ...DR....DF......T | G...D. | E.TR.N.....Q | A..A........ | 0.04 | 7 |
| ..... | F................. | .V........F....... | ...... | ............ | .RHDT..YET.H | 0.04 | 7 |
| .A... | F.....ST..SV.K.H.M | T.ASH....DF......T | ...D.. | ............ | A..A...NEA.H | 0.04 | 7 |
| ..... | ................. | .........NF....... | R...D. | EDTAASDA...R | A..A........ | 0.04 | 7 |
| ..... | ................. | ................. | ...DD. | EN.G.A....KQ | A..A........ | 0.04 | 7 |
| ..... | ................. | ................. | ...... | ENGGTN..E.GN | A..A........ | 0.04 | 7 |
| ..... | F................. | ..DGE....DF....... | ...DDR | ............ | ............ | 0.04 | 7 |
| ..... | ................. | ................. | ...DDR | ES.AA..I.... | A..A........ | 0.04 | 7 |
| G.... | F.....GNG.HV.H.G.R | ..DGE....DF....... | ...... | .N.TA.DI.VDG | A..A........ | 0.04 | 7 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ..... | .................K | .........DF......T | R...G. | .DAD.A.AEFGQ | A..A........ | 0.04 | 7 |
| ..... | .................. | ..HG.....NF......T | ..A... | E.TSGGD.E..Q | A..A........ | 0.04 | 7 |
| .T... | F.....GN..IK.L.G.K | .Q.DR.....F | ....D. | ............ | A..A........ | 0.04 | 7 |
| TA... | .................. | ..ADH....DF....... | G..A.R | ............ | A..A........ | 0.04 | 7 |
| ..... | .................. | | R..AGR | ............ | A..A........ | 0.04 | 7 |
| AA... | F......G..RP.L.A.G | T..NE....DF......T | E..... | ............ | ............ | 0.04 | 7 |
| .A... | .................. | TQDS.....NF....... | ...... | .DGGGN.....R | A..A........ | 0.04 | 7 |
| ..... | F................. | .V........F....... | ...... | ............ | KQSSA..VR..H | 0.04 | 7 |
| N.... | F.....GRG.N......H | .........NF....... | R...D. | ............ | A..A........ | 0.04 | 7 |
| G.... | F.....SA..RA.....R | .PPNG.....F......T | ...DDR | E.AGG.D.E.DS | A..A........ | 0.04 | 7 |
| A.... | F.....GSA.RP.N.H.K | ..DGE....DF....... | ....GR | ENAGASDIA.DH | ............ | 0.04 | 7 |
| TA... | F................. | .V........F....... | ....D. | ............ | A..A........ | 0.04 | 7 |
| AA... | .................. | TQP.R....NF......T | R...D. | ..A.G...AYD. | A..A........ | 0.04 | 7 |
| ..... | .................. | .................. | ...... | .S.ATGDTE.DG | ............ | 0.04 | 7 |
| DA... | .................. | .................. | R..A.. | E.GG.....FD. | A..A........ | 0.04 | 7 |
| ..... | .................. | .................. | ...ADR | E.AG..D.A.GE | A..A........ | 0.04 | 7 |
| ..... | F................. | .V........F....... | ...... | ............ | TASSA..Y.A.. | 0.04 | 7 |
| ..... | .................. | .................. | R..ND. | ..AG.N.AA.GQ | A..A........ | 0.04 | 7 |
| ..... | .................. | ..HG.....NF......T | R..AGR | ............ | A..A........ | 0.04 | 7 |
| ..... | .................. | T.AG.....NF......T | ...... | .D.GGGD.EVDE | A..A........ | 0.04 | 7 |
| ..... | F................. | .................. | G..N.. | ............ | A..A........ | 0.04 | 7 |
| ..... | .................. | .................. | ...TD. | .SGGRS..E.DQ | A..A........ | 0.04 | 7 |
| ..... | F................. | .V........F....... | ...... | ............ | KTKTP..FDG.. | 0.04 | 7 |
| ..... | .................. | .........DF....... | ...A.. | ............ | A........... | 0.04 | 7 |
| ..... | .................. | .................. | R..ND. | E..RRDD..V.Q. | A..A........ | 0.04 | 7 |
| ..... | .................. | .................. | G...D. | ............ | A..A........ | 0.04 | 7 |
| GT... | F.....AEG.LK.M.H.L | ..DGE....DF.R..... | ...... | ............ | ............ | 0.04 | 7 |
| ..... | F................. | .V........F....... | ...... | ............ | KRSNG..V.G.D | 0.04 | 7 |
| RA..T | .................. | T.P......DF....... | ...DDR | ..AGG..T..GR | A..A........ | 0.04 | 7 |
| TA..T | .................. | .................. | ...D.. | .SGS.NDIA..D | A..A........ | 0.04 | 7 |
| A.... | ......SRT..A...... | T.P......DF....... | ...DD. | ............ | A..A........ | 0.04 | 7 |
| E.... | F.....AGG.P..L...G | .V........F....... | ...... | EN.GE..IA.DR | ............ | 0.04 | 7 |
| ..... | .................. | .................. | E..NG. | ............ | GTRGT..ADA.Q | 0.04 | 7 |
| ..... | .................. | .................. | E..ND. | ............ | GARGN...Q..K | 0.04 | 7 |
| ..... | F................. | .V........F....... | ...... | ............ | G.HAP..SER.. | 0.04 | 7 |
| D.... | ......ARG.IA.I.E.G | .Q.DR.....F | ....D. | ..AST..AA..D | A..A........ | 0.04 | 7 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ..... | ................. | .................. | R...D. | EDANG...EVDR | A..A........ | 0.04 | 7 |
| ..... | F................ | ..........F....... | ...DD. | ............ | GPHAG..FDT.A | 0.04 | 7 |
| ..... | ................. | .................. | ...A.R | ............ | A..A........ | 0.04 | 7 |
| ..... | ................. | .................. | ...DDR | .DAD.A....G. | A..A........ | 0.04 | 7 |
| TA... | F................ | .V........F....... | ...... | ............ | SARSA..AD..A | 0.04 | 7 |
| ..... | F................ | ...............T | ...A.. | .SAKAA.AA.DE | ............ | 0.04 | 7 |
| ..... | ................. | T..SG....DF......T | ...DD. | E.GSAA.A.VDQ | A..A........ | 0.04 | 7 |
| ..... | ................. | .................. | E..AG. | ............ | A..A........ | 0.04 | 7 |
| ..... | ................. | .................. | R..D.. | ..ASAAD.E..D | A..A........ | 0.04 | 7 |
| ..... | ................. | .................. | ...... | ...TG..T..GQ | A..A........ | 0.04 | 7 |
| ..... | ................. | .................. | G..KD. | ............ | A..A........ | 0.04 | 7 |
| ..... | ................. | ..ATR....DF....... | ....D. | ............ | A..A........ | 0.04 | 7 |
| ST..T | F................ | .V........F....... | ...... | ............ | GTRT...DRA.. | 0.04 | 7 |
| R.... | F.....DEA.RQ.T.N.L | .........NF...... | R...D. | ..ASE...E.D. | A..A........ | 0.04 | 7 |
| ..... | F.....NTG.PP.T.Q.S | ........DF....... | ...... | ............ | ............ | 0.04 | 7 |
| DA... | F.....DEA.RQ.T.N.L | .........NF...... | R...D. | ..ASE...E.D. | A..A........ | 0.04 | 7 |
| ..... | ................. | .................. | R...GR | .SAKAA.AA.DE | A..A........ | 0.04 | 7 |
| AA... | ................. | .Q.......DF....... | G..AGR | E..TGSD..VDR | A..A........ | 0.04 | 7 |
| ..... | F.....NTG.RN.T.T.L | .QP.G.....F....... | ...... | ............ | A..A........ | 0.04 | 7 |
| DA..T | F.....SKT.NE.P...M | .K.TG....DF....... | R..DR | ............ | A..A........ | 0.04 | 7 |
| NT..T | F.....NN..SA.N...R | ...SG....DF......T | ...... | ............ | A..A........ | 0.04 | 7 |
| ..... | ................. | .................. | R..DGR | ............ | A..A........ | 0.04 | 6 |
| ..... | ................. | .................. | ...DDR | ..ASES...VDG | A..A........ | 0.04 | 6 |
| ..... | F................ | .V........F....... | ...... | ............ | GTKDG..YQE.A | 0.04 | 6 |
| ..... | ................. | .................. | ....GR | ...GAD.IA..F | A..A........ | 0.04 | 6 |
| GT... | ................. | .................. | ...DDR | ............ | TRRDP..DNM.T | 0.04 | 6 |
| ..... | ................. | ........DF....... | ..D... | ENGT.G.I.... | A..A........ | 0.04 | 6 |
| ..... | F................ | .V........F....... | ...... | ............ | GPRTA..AGE.A | 0.04 | 6 |
| ..... | F................ | .V........F....... | ...... | ............ | S.KGG..VTT.A | 0.04 | 6 |
| ..... | F.....AEG.LK.M.H.L | ..ADH....DF....... | ...... | ............ | A..A........ | 0.04 | 6 |
| GT... | ................. | ..........F....... | ...... | ES.GEG...VDS | A..A........ | 0.04 | 6 |
| ..... | F.....GGG.HN.H.T.M | .V........F....... | ...... | ............ | A..A........ | 0.04 | 6 |
| GT... | ................. | .................. | E..NG. | ............ | A..A........ | 0.04 | 6 |
| ..... | ................. | .V........ | R..N.. | ............ | TPRNN...EV.D | 0.04 | 6 |
| ..... | ................. | .................. | ....D. | ............ | ............ | 0.04 | 6 |
| ..... | ................. | .................. | R...DR | .N.AGNDAAVDE | A..A........ | 0.04 | 6 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| GA... | ................. | .QDT......F......T | R..KD. | ............ | A..A........ | 0.04 | 6 |
| NT... | ................. | .KAS.....NF......T | E..DD. | ............ | A..A........ | 0.04 | 6 |
| SA... | F.....NGG.IM.L.E.R | ..DGE....DF....... | ...... | ENAAAN.A.Y.S | A..A........ | 0.04 | 6 |
| ..... | ................. | .Q.S.....DF....... | ...D.. | ENGRGG.AEV.D | A..A........ | 0.04 | 6 |
| ..... | ................. | ................T | G..TG. | ............ | ............ | 0.04 | 6 |
| ..... | ................. | ................. | ....DR | ............ | ............ | 0.04 | 6 |
| ..... | ................. | ................. | R..DD. | EN.SAGD..... | A..A........ | 0.04 | 6 |
| ..... | ................. | .........DF......T | ...D.. | E.AGEG.I...R | A..A........ | 0.04 | 6 |
| ..... | F................. | .V........F....... | ...... | ............ | NARNT..A...T | 0.04 | 6 |
| TT... | F.....DNG..D.M.G.R | .KDSR....DF....... | ...DD. | ............ | A..A........ | 0.04 | 6 |
| ..... | ................. | TKDT.....NF......T | G..A.F | ............ | A..A........ | 0.04 | 6 |
| T...T | ................. | ................. | R..DDR | .NAG.DD...DQ | A..A........ | 0.04 | 6 |
| ..... | ................. | ................. | ...D.. | ..TARN.....R | A..A........ | 0.04 | 6 |
| ..... | F................. | .V........F....... | ...... | ............ | GQ.TP..IRT.A | 0.04 | 6 |
| NA..T | F.....NNG.R....N.G | T.ASH....DF....... | ...D.R | ..AG.N.AA.GQ | A..A........ | 0.04 | 6 |
| NA... | F.....NGG.NV.N.K.G | .Q.DR.....F....... | ....D. | ............ | A..A........ | 0.04 | 6 |
| ..... | ................. | ................. | ....GR | ...G.S..AFGD | A..A........ | 0.04 | 6 |
| ..... | F................. | .V........F....... | ...... | ............ | NTKSG..SSG.D | 0.04 | 6 |
| AA... | F.....NAT.RD.M.T.K | .QPN......F......T | ...N.. | ............ | A..A........ | 0.04 | 6 |
| ..... | ................. | ................. | G..N.. | .SARG..A..DE | A..A........ | 0.04 | 6 |
| ..... | F................. | .V........F... | ...... | ............ | TQRT...DRS.. | 0.04 | 6 |
| D.... | ................. | T.PTG....DF....... | ...DDR | .NATG....VGS | A..A........ | 0.04 | 6 |
| ....T | ................. | ................. | ...... | ............ | ............ | 0.04 | 6 |
| A.... | F.....DQ..R..P.S.R | T.ASH....DF....... | ...... | ..ASE...E.D. | A..A........ | 0.04 | 6 |
| NT..T | F.....GRT.S..L.G.R | .V........F....... | ...... | ES.AA..I.... | A..A........ | 0.04 | 6 |
| ..... | ................. | ................. | ...... | E.T..S.IE.GD | A..A........ | 0.04 | 6 |
| ..... | ................. | ................. | ...DDR | ............ | AD.GG..VQG.A | 0.04 | 6 |
| ..... | ................. | ................. | E..KD. | ............ | A..A........ | 0.04 | 6 |
| ..... | ................. | ................. | ...... | ESAN...I...H | A..A........ | 0.04 | 6 |
| A.... | F................. | .V........F....... | .Y.... | ............ | GKRGT..DDS.. | 0.04 | 6 |
| ..... | ................. | ................. | ....D. | ENTATDD...GH | A..A........ | 0.04 | 6 |
| E.... | ................. | .Q.S......F....... | E..N.. | .DASGSD..Y.R | A..A........ | 0.04 | 6 |
| ....T | F.....GTG..P.T.D.R | ..AGQ....NF....... | ...DD. | E.AGTNDI...R | A..A........ | 0.04 | 6 |
| ..... | F.....SAA..D.I.... | ..HG.....NF......T | ...A.. | .SAKAA.AA.DE | A..A........ | 0.04 | 6 |
| ..... | ................. | ................. | ...DDR | .SAKGS.AAYDS | A..A........ | 0.04 | 6 |
| ..... | F................. | .QP.G.....F....... | ...D.R | ............ | A..A........ | 0.04 | 6 |

TABLE 7-continued

AAV capsid proteins having increased specificity for and/or transduction of CD44+ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| RA..T | F......G..NL.I...R | .Q.DR.....F....... | ....D. | ........... | ........... | 0.04 | 6 |
| ..... | F.....NNA.S..T.E.G | T.PNE....DF....... | R...D. | E.......... | ........... | 0.04 | 6 |
| ..... | F.....GS..NM.N.T.R | .KDSR....DF....... | ...DDR | .DATA..A.Y.H | A..A........ | 0.04 | 6 |
| GT... | F.....AEG.LK.M.H.L | ..DGE....DF....... | ...... | ........... | A..A........ | 0.04 | 6 |
| R.... | ................. | TKDDR....NF....... | ....D. | ...AAA.IE..Q | A..A........ | 0.04 | 6 |
| ..... | F................. | .V........F....... | ...... | ........... | KRQST..STE.Q | 0.04 | 6 |
| T...T | ................. | .QPN......F......T | ...N.. | ..TG.D..A.GG | A..A........ | 0.04 | 6 |
| H.... | F.....SNG.P....T.R | ..YN.....DF....... | ...D.. | .SGGA...AFGD | A..A........ | 0.04 | 6 |
| ..... | F.....NR..NM.L.Q.G | .Q.S......F....... | ....G. | ........... | A..A........ | 0.04 | 6 |
| AA... | F......RG.SP.K.S.N | ..DGE....DF....... | ...... | ........... | A..A........ | 0.04 | 6 |
| ..... | ................. | .QAS......F....... | ...... | ........... | A..A........ | 0.04 | 6 |
| ..... | F.....GKT.I..N...S | TQASG.....F....... | ...D.. | E.ATAS.AAFDE | A..A........ | 0.04 | 6 |
| HA... | F.....GT.....L...S | T.P......DF....... | ...D.. | ........... | A..A........ | 0.04 | 6 |
| ..... | F................. | .V........F....... | ...... | .SADGSD...DR | A..A........ | 0.04 | 6 |
| TA..T | ................. | ................. | G..DG. | ........... | ........... | 0.04 | 6 |
| ..... | ................. | ................. | ...DD. | ...NRAD.E.DR | A..A........ | 0.04 | 6 |
| AA... | F.....SKG.NV.L.T.G | .QP.G.....F....... | E..AD. | ........... | A..A........ | 0.04 | 6 |
| ..... | ................. | ................. | ...D.R | .SAKAA.AA.DE | A..A........ | 0.04 | 6 |
| ..... | F................. | .V........F....... | ...... | ........... | DERGH..SDN.E | 0.04 | 6 |
| ..... | ................. | ................. | ...NDR | E.A.AD.AAF.. | A..A........ | 0.04 | 6 |
| ..... | ................. | .Q.GQ....DF....... | R..TDR | .DAG.S.A..DR | A..A........ | 0.04 | 6 |
| ..... | ................. | ..DGE....DF....... | R...D. | .STDRA...... | A..A........ | 0.04 | 6 |
| ..... | F................. | .V........F....... | ...DDR | E.A.G..A...N | A..A........ | 0.04 | 6 |
| ..... | ........N........ | ................. | R..DD. | ED.KAN..A.D. | A..A........ | 0.04 | 6 |
| HT..T | ................. | ..PN.....NF....... | R...D. | ESTGGND.EYDQ | A..A........ | 0.04 | 6 |
| ..... | F................. | .QPTR.....F....... | E..NG. | ........... | A..A........ | 0.04 | 6 |
| TA... | F.....ANG.HL.K.K.S | ................. | G..N.. | ........... | A..A........ | 0.04 | 6 |
| GA... | F.....ANG.HL.K.K.S | .Q.S......F....... | ...DDR | E.AGGS..AVDG | A..A........ | 0.04 | 6 |
| ..... | ................. | ..HG.....NF......T | E..DD. | ........... | AARTT..SGG.D | 0.04 | 6 |
| TT..T | F......EA.SL.K.Q.R | .QPG......F....... | ....D. | ........... | A..A........ | 0.04 | 6 |
| ..... | ................. | ................. | ...ND. | ..AGTN...NDE | A..A........ | 0.04 | 6 |
| ..... | ................. | ................. | ...N.. | ESAGA....Y.R | A..A........ | 0.04 | 6 |
| RT... | ................. | ..YN......F......T | ...D.R | ...TG..T..GQ | A..A........ | 0.04 | 6 |
| DA... | F......EG.LQ.M.A.K | .KDSR....DF....... | ...DDR | ........... | A..A........ | 0.04 | 6 |
| ..... | ................. | ................. | ...D.R | E.AST...E.GH | A..A........ | 0.04 | 6 |
| ..... | ................. | ........F......T | ...DG. | ........... | A..A........ | 0.04 | 6 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| EA... | .................... | .QD......DF..P.... | G..K.. | .S.G.S.IA..G | A..A........ | 0.04 | 6 |
| N.... | F.....GN..RM.T...E | ..HG.....NF......T | ...A.. | E.AG...IA.DD | A..A...SDR... | 0.04 | 6 |
| ..... | .................... | .QD......DF......T | R..DG. | .STAEG...F.. | A..A........ | 0.04 | 6 |
| ..... | F.....SN...P.H.T.K | TQ.TG............. | ...... | .DAKG..I.FDG | A..A........ | 0.04 | 6 |
| SA..T | F.....DGA.R..P.A.K | .Q.GQ....DF...... | ....G. | ...AAS.A.VGQ | A..A........ | 0.04 | 6 |
| G.... | .................... | TK.NE...NF....... | ...DDR | ............ | A..A........ | 0.04 | 6 |
| DT..T | .................... | ..........F...... | ...D.. | ............ | SNST...YHV.E | 0.04 | 6 |
| ..... | F.................. | .................. | ...DD. | .STGAD.....Q | A..A........ | 0.04 | 6 |
| ..... | .................... | TK.D.....NF......T | R..AG. | ............ | A..A........ | 0.04 | 6 |
| G...T | .................... | .KYT.....NF....... | ...NDR | ED.R.S.A...G. | A..A........ | 0.04 | 6 |
| G.... | .................... | .QP.G.....F....... | R..DDR | ............ | A..A........ | 0.04 | 6 |
| ..... | F.....S.T.NM.N.T.R | TQDS.....NF....... | ...A.. | .SAKAA.AA.DE | A..A........ | 0.04 | 6 |
| ..... | .................... | ..DGE....DF....... | ...... | ..TNESD..... | A..A........ | 0.04 | 6 |
| ..... | F.................. | .V........F....... | ...... | ............ | DPRAS..FKR.D | 0.04 | 6 |
| ..... | .................... | .QANH....NF......T | ...... | ............ | A..A........ | 0.04 | 6 |
| H.... | .................... | .PPNG.....F......T | ...DDR | E.TR.N.....Q | A..A........ | 0.04 | 6 |
| G.... | F.....NTG.LH.T...R | .PPN......F....... | ...D.. | ............ | A..A........ | 0.04 | 6 |
| ..... | .................... | ..............R... | ...D.. | ..TG.N.AA.GQ | A..A........ | 0.04 | 6 |
| EA... | .................... | .................. | G..DG. | ............ | ............ | 0.04 | 6 |
| ..... | ......SDT.I..L.... | ..PN.....NF....... | ...NDR | ............ | A..A........ | 0.04 | 6 |
| ..... | F.................. | .V........F....... | ...... | ............ | G.RSG..FTG.. | 0.04 | 6 |
| AA... | F.....GN..HM.P...R | TKDT.....NF....... | ...DDR | EDAGT...AFD. | A..A........ | 0.04 | 6 |
| ..... | .................... | .................. | ...DDR | ESGRANDA...S | A..A........ | 0.04 | 6 |
| G.... | .................... | .................. | ...... | ............ | ............ | 0.04 | 6 |
| ..... | F.....ANG.HL.K.K.S | ..DGE....DF....... | ...... | ............ | A..A........ | 0.04 | 6 |
| ..... | ....S.............. | .V........F....... | E..TD. | ............ | ............ | 0.04 | 6 |
| ..... | .................... | ..DD.....DF....... | E..AD. | E..RRA.....Y | A..A........ | 0.04 | 6 |
| NA... | F.....GQG.IA.....K | .................. | ...... | ............ | A..A........ | 0.04 | 6 |
| TA... | F.................. | .V........F....... | ...... | ............ | .R.T...SDV.D | 0.04 | 6 |
| NA... | F.....ATG.NV.T.G.R | .Q.DR.....F....... | ....D. | EDAGT...AFD. | A..A........ | 0.04 | 6 |
| R.... | .................... | TQ.TG...DF....... | ...DDR | E..KAS..AVDH | A..A........ | 0.04 | 6 |
| ..... | .............T.R | ..PN.....NF....... | ...NDR | ............ | A..A........ | 0.04 | 6 |
| ..... | F......A..NV...T.. | .................. | ...DDR | ............ | A..A........ | 0.04 | 6 |
| ..... | F.....S.G.RM.L.G.. | .Q.......DF....... | ...D.. | ............ | A..A........ | 0.04 | 6 |
| TT..T | .................... | ..DGE...DF....... | R...D. | ............ | ............ | 0.04 | 6 |
| ..... | .................... | .................. | ....D. | ENGAGN.TEV.N | A..A........ | 0.04 | 6 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | ................. | ................. | R...D. | EN.SAGD..... | A..A........ | 0.04 | 6 |
| A...T | ................. | TQ.TG....DF....... | ...D.. | .SG..ND...DG | A..A........ | 0.04 | 6 |
| ..... | F......TG.KA.I.G.K | .QPN......F......T | R..... | .DAS.N...VDG | A..A........ | 0.04 | 6 |
| ..... | ................. | .........NF......T | E..NG. | E.GAA.D...DQ | A..A........ | 0.04 | 6 |
| N.... | F.....GRT.S..L.G.L | .QD.E.....F..P.... | ...... | ............ | A..A........ | 0.04 | 6 |
| ..... | F..S............. | .V........F....... | ...... | ............ | GARTR..DNV.E | 0.04 | 6 |
| ..... | ................. | ..........F......T | ...D.R | ..G..AD.A.GD | A..A........ | 0.04 | 6 |
| ..... | ................. | .K.T.....DF....... | E..ND. | ...TG..T..GQ | A..A........ | 0.04 | 6 |
| AA... | ................. | .V........F....... | E..TDR | ............ | ............ | 0.04 | 6 |
| ..... | F.....A...ND.T...K | .QPN......F......T | ...ADR | .D.GRA...F.. | A..A........ | 0.04 | 6 |
| E.... | ......SK..PA.K.A.G | .V.......VF....... | ...... | .DGGGN.....R | A..A........ | 0.04 | 6 |
| RA... | ................. | ................. | ...DD. | ES.TG..I.FDR | A..A........ | 0.04 | 6 |
| GA... | F................ | ................. | ...ADR | ............ | A..A........ | 0.04 | 6 |
| ..... | F.....DRG.SL.M...I | ................. | ...DDR | ............ | A..A........ | 0.04 | 6 |
| ..... | ................. | T.P......F........ | ...DDR | ............ | ............ | 0.04 | 6 |
| ..... | ................. | ..DGE....DF....... | ...D.. | ............ | ............ | 0.04 | 6 |
| ..... | F................ | .V........F....... | ...... | ............ | GAKGN..SG..T | 0.04 | 6 |
| ..... | ................. | .PPNG.....F......T | ...DDR | E.TR.N..AV.. | A..A........ | 0.04 | 6 |
| D...T | .......GT.NM.L.Q.G | .Q.S......F....... | ....D. | ............ | ............ | 0.04 | 6 |
| TT... | F.....ASA.S..T.T.G | ..YN......F......T | R..TG. | ............ | A..A........ | 0.03 | 5 |
| NA... | F.....SA..RA.....R | ..DGE....DF....... | ...... | .NGG.ND....Q | A..A........ | 0.03 | 5 |
| ..... | ................. | ................. | ...... | E..TGS..EYDR | A..A........ | 0.03 | 5 |
| ..... | F................ | .V........F....... | ...... | ............ | NTRGP..NGI.. | 0.03 | 5 |
| NA... | F.....GTG.S..H.T.N | ..PN.....NF....... | ...NDR | ............ | A..A........ | 0.03 | 5 |
| ..... | ................. | .QAS......F....... | ...... | .SGKE.D...GQ | A..A........ | 0.03 | 5 |
| ET... | ................. | ................. | E..TG. | ............ | ............ | 0.03 | 5 |
| D.... | F.....GA..SQ.H.G.M | .PANG.....F....... | ...DDR | ............ | A..A........ | 0.03 | 5 |
| TA... | ................. | .QPN......F......T | ...N.. | ...G.D..EVGQ | A..A........ | 0.03 | 5 |
| RA... | ................. | .QYGQ....DF......T | ...K.. | ............ | A..A........ | 0.03 | 5 |
| ..... | F.....SRG.IE.K...L | ..YN......F......T | R..DG. | ............ | A..A........ | 0.03 | 5 |
| ..... | ................. | .........NF......T | ...D.R | .DTGEADA.VDG | A..A........ | 0.03 | 5 |
| AT..T | ................. | .Q.DR.....F....... | ....D. | ..TR.ND.A.DE | A..A........ | 0.03 | 5 |
| SA... | F.....DNT.SK.L...K | TKAGE....NF......T | R...G. | .SG..ND...DG | A..A........ | 0.03 | 5 |
| ....T | F................ | .V........F....... | ...... | ............ | THRAT..ADG.Q | 0.03 | 5 |
| RA... | F.....AHT.LK.N...G | .V........F....... | ...... | ..AGRADIEVGS | A..A........ | 0.03 | 5 |
| ..... | ................. | TKAG.....NF....... | ....GR | ............ | A..A........ | 0.03 | 5 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| TA..T | F.....SGT.S..T.T.. | .Q.DH....NF....... | ...DD. | ............ | A..A........ | 0.03 | 5 |
| ..... | F................. | .V........F....... | ...... | ............ | THRAT..ADG.Q | 0.03 | 5 |
| ..... | F.....NDG.PA.K.T.R | ..PN.....NF....... | ...NDR | ............ | A..A........ | 0.03 | 5 |
| DA... | F......NG.LQ.H...N | T.P......DF....... | ...D.. | ............ | A..A.....N.A | 0.03 | 5 |
| S.... | F.....GHA.SK.T.E.K | .Q.S......F....... | E..N.. | EDAKGND.A..N | A..A........ | 0.03 | 5 |
| ..... | ................. | .................. | R..DD. | EDGAGD.IEVDQ | A..A........ | 0.03 | 5 |
| ..... | F................. | .........F....... | E..TD. | ............ | ............ | 0.03 | 5 |
| ..... | ................. | ........DF....... | E..N.. | E........... | ............ | 0.03 | 5 |
| ..... | F................. | .V........F....... | ...... | ............ | DRSGR..NRG.D | 0.03 | 5 |
| ..... | F................. | .V........F....... | ...... | ............ | GPRDG..V.N.A | 0.03 | 5 |
| D...T | ................. | ..PDG....NF....... | ....DR | ............ | A..A........ | 0.03 | 5 |
| TA... | F.....S.G.RM.L.G.. | .V........F....... | ...... | ............ | A..A........ | 0.03 | 5 |
| G.... | F.....G.G.RA.N.E.R | .KYT.....NF......T | ...DD. | ............ | A..A........ | 0.03 | 5 |
| TA... | ................. | .V........F....... | ...... | ............ | ............ | 0.03 | 5 |
| ..... | F................. | .V........F....... | ...... | ............ | A.QNR..VDT.H | 0.03 | 5 |
| E.... | F................. | .QANH....DF....... | ...DDR | ............ | A..A........ | 0.03 | 5 |
| AT..T | F.....SSA.NV.K.G.R | ..HG.....NF......T | R..N.. | .SAGAN..E..S | A..A........ | 0.03 | 5 |
| ..... | F................. | .V........F....... | ...... | ............ | GRQSH..FTM.D | 0.03 | 5 |
| ..... | ................. | .................. | ...... | ............ | KDRNG...GK.D | 0.03 | 5 |
| TA... | ................. | .................. | G..K.. | E..G.A..E.GR | A..A........ | 0.03 | 5 |
| GA... | F................. | .V........F....... | ...... | ............ | AR.G...IDV.H | 0.03 | 5 |
| ..... | ................. | ....G...NG....... | ...TGR | ............ | A..A........ | 0.03 | 5 |
| ..... | ................. | .Q.S......F....... | ...T.. | ............ | A..A........ | 0.03 | 5 |
| ..... | ................. | ...............T | ...D.. | E..KAS..AVDR | A..A........ | 0.03 | 5 |
| EA... | ................. | ..YG.....F......T | ...D.R | ENGD....E.DR | A..A........ | 0.03 | 5 |
| .A... | F................. | .V........F....... | ...... | ............ | ............ | 0.03 | 5 |
| DT... | F.....GAG.RA.L.D.R | .................. | ....GR | ..AG.N.AA.GQ | A..A........ | 0.03 | 5 |
| ..... | ................. | .V........F....... | ...... | ............ | K.QNG..VEG.H | 0.03 | 5 |
| E.... | F.....SGA..V...Q.G | .QP.G.....F....... | R..NDR | ............ | A..A........ | 0.03 | 5 |
| AA... | F................. | .V........F....... | ...... | ............ | SERTG..DGT.T | 0.03 | 5 |
| ..... | F................. | .V........F....... | ...... | ............ | SHRTO..DNE.A | 0.03 | 5 |
| GT..T | F.....NGG.NI.K.E.R | .................. | ...... | ESGARND...DS | A..A........ | 0.03 | 5 |
| ..... | ................. | .................. | ...... | E.AG..D.A.GR | A..A........ | 0.03 | 5 |
| TA... | F.....STG..N.M.T.. | .K.TG....DF....... | ...... | ............ | A..A........ | 0.03 | 5 |
| ..... | ................. | ..P......DF....... | ...ND. | E.AKGSD.AY.G | A..A........ | 0.03 | 5 |
| GT... | ................. | .................. | E..ND. | ............ | ............ | 0.03 | 5 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| EA... | F................. | .V........F....... | ...... | ............ | DRSGA...RS.A | 0.03 | 5 |
| EA... | F................. | ................ | ...D.. | ............ | A..A........ | 0.03 | 5 |
| SA... | ................ | .KPSG....NF....... | ....D. | ESGTTA.A...H | A..A........ | 0.03 | 5 |
| ..... | F................. | .QPSR.....F....... | ...D.. | ............ | A..A........ | 0.03 | 5 |
| ..... | ................ | ................ | R..D.. | .NGST.....GG | A..A........ | 0.03 | 5 |
| ..... | ...............R | ................ | ...AG. | E.GGTS.AE.D. | A..A........ | 0.03 | 5 |
| TA... | F.........LA...H.G | .V........F....... | ...... | ............ | ............ | 0.03 | 5 |
| TT... | F.....GRT.IE.N.T.R | .QAS.....NF......T | E..DGR | ............ | ............ | 0.03 | 5 |
| A.... | F.....SGT.S..T.T.. | ..DGE....DF....... | ...... | .S.D.D...FGE | A..A........ | 0.03 | 5 |
| ..... | F.....DGA.R..P.A.K | T.P......DF....... | ....D. | ............ | A..A........ | 0.03 | 5 |
| ..... | F................. | .V........F....... | ...... | ............ | GRRDP..DGT.H | 0.03 | 5 |
| ..... | ................ | ................ | ....D. | E........... | A..A........ | 0.03 | 5 |
| G.... | ................ | .Q.GQ....DF....... | ....G. | E..TEG...VDS | A..A........ | 0.03 | 5 |
| ..... | ................ | ................ | R..KG. | ............ | A..A........ | 0.03 | 5 |
| SA... | ................ | .Q.GQ....DF....... | ....G. | ............ | A..A........ | 0.03 | 5 |
| SA... | F......TT..V.M.T.E | T.P......DF....... | ...D.. | ............ | A..A........ | 0.03 | 5 |
| ..... | .......SA.RI.T.G.R | .KDDG....NF....... | ...DDR | ED.AGNDIA.GE | A..A........ | 0.03 | 5 |
| GT... | F.....A...ND.T...K | .QPN......F......T | ...ADR | .D.GRA...F.. | A..A........ | 0.03 | 5 |
| ..... | F.....AGT.RD.M.A.L | .........NF....... | ....D. | ............ | A..A........ | 0.03 | 5 |
| ..... | F................. | .V........F....... | ...... | ............ | GARTP..F.G.H | 0.03 | 5 |
| RA... | F.....SRG..L.P.G.G | .QPSE....DF....... | ...DD. | ............ | A..A........ | 0.03 | 5 |
| GT... | F.....AEG.LK.M.H.L | ................ | ...... | ............ | A..A........ | 0.03 | 5 |
| .A... | ................ | ................ | ...DDR | ..AAGADTA.DD | A..A........ | 0.03 | 5 |
| SA... | ................ | .Q.S......F....... | ...DDR | ............ | A..A........ | 0.03 | 5 |
| NA..T | ................ | TQASG....NF....... | ....D. | E.AS...IEYGQ | A..A........ | 0.03 | 5 |
| ..... | ................ | .QPSR.....F....... | ...... | ............ | A..A........ | 0.03 | 5 |
| ..... | ................ | ................ | ...... | E...GA.AA..E | A..A........ | 0.03 | 5 |
| G.... | ................ | .QATQ....NF......T | ...N.R | EDAGT...AFD. | A..A........ | 0.03 | 5 |
| NA... | F......KT.NV.K.T.H | TKA......NF......T | R..D.R | E..R.N.AEFGE | A..A........ | 0.03 | 5 |
| NA..T | F................. | .V........F....... | ...... | ............ | SRQAH..SDM.E | 0.03 | 5 |
| G.... | F.....GDG....K.Q.R | .........F......T | ...DDR | ESAGRSDTA.DE | A..A........ | 0.03 | 5 |
| ..... | ................ | .........NF....... | ...DD. | E.G.RBD.EVDE | A..A........ | 0.03 | 5 |
| D...T | F.....AEG.LK.M.H.L | ..DGE....DF....... | ...... | ............ | ............ | 0.03 | 5 |
| G.... | ................ | .QDT.....DF....... | G..DG. | ............ | ............ | 0.03 | 5 |
| TA... | ................ | ................ | R..DD. | ............ | ............ | 0.03 | 5 |
| EA... | ................ | ................ | ....GR | E..TRS.AE.GS | A..A........ | 0.03 | 5 |

TABLE 7-continued

AAV capsid proteins having increased specificity for and/or transduction of CD44+ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| D...T | ................ | ................ | ...NDR | ..AKG...AV.. | A..A........ | 0.03 | 5 |
| TA... | F.....DAA.IK.T.Q.N | ..DGE....DF....... | ...... | E.......... | ............ | 0.03 | 5 |
| TA... | F.....SAA.NK.L.G.L | ..PNG....DF....... | R..DD. | ............ | A..A........ | 0.03 | 5 |
| ..... | ................ | ................ | ...D.. | EDGMGSD.E.DQ | A..A......T. | 0.03 | 5 |
| A.... | ................ | .QD.E.....F..P.... | ...D.. | ............ | ............ | 0.03 | 5 |
| ..... | ................ | ................ | ...D.R | ..ASES...VDG | A..A........ | 0.03 | 5 |
| SA..T | F.....AAG.RV.L.K.R | ..DGE....DF....... | ...... | ............ | A..A........ | 0.03 | 5 |
| .A... | F.....AST.HD.T.E.R | T.P......DF....... | ...DG. | ............ | ............ | 0.03 | 5 |
| ..... | ................ | .QDT.............. | ....D. | ............ | A..A........ | 0.03 | 5 |
| D.... | F.....DGA.RN.T.S.G | .RPT.....DF....... | G..KGR | ............ | A..A........ | 0.03 | 5 |
| ..... | F................ | .V........F....... | ...... | ............ | TR.NP..DGV.T | 0.03 | 5 |
| ..... | F................ | .V........F....... | ...... | ............ | GP.N...VGA.K | 0.03 | 5 |
| ..... | F................ | .V........F....... | ...... | ............ | GARGA..VHN.A | 0.03 | 5 |
| ..... | F................ | ................ | E..N.. | ............ | A..A........ | 0.03 | 5 |
| ..... | F................ | ..........F....... | ...... | ............ | TAQA...AP..T | 0.03 | 5 |
| E.... | ................ | ................ | R..TD. | ............ | A..A........ | 0.03 | 5 |
| GT... | F................ | TQ.TG....DF....... | ...A.. | ............ | GQKDR...ST..H | 0.03 | 5 |
| ..... | ................ | ................ | ...D.. | ENTKGD....D. | A..A........ | 0.03 | 5 |
| TT..T | ................ | ..........F....... | ...... | ............ | ............ | 0.03 | 5 |
| RA... | F................ | TQDGE....DF....... | ....D. | ED.GAG..AV.G | A..A........ | 0.03 | 5 |
| ..... | F................ | .V........F....... | ...... | ............ | GKQTT..SEG.T | 0.03 | 5 |
| AA... | ................ | ................ | ...DDR | ............ | A..A........ | 0.03 | 5 |
| TA... | ................ | .QPN......F......T | ...N.. | ..TG.D..A.GG | A..A........ | 0.03 | 5 |
| ..... | ................ | ..........NF......T | E..N.. | E.TR.N.....Q | A..A........ | 0.03 | 5 |
| ..... | F......GA.NM.T.A.G | .KDSR....DF......T | R..D.. | ..A.A.D.AFDS | A..A........ | 0.03 | 5 |
| ST... | F.....G.T.II.P.D.R | ..DGE....DF....... | ...... | ..AGAN...FGE | ............ | 0.03 | 5 |
| ..... | ................ | ................ | ...NDR | E.ATA...E.DD | A..A........ | 0.03 | 5 |
| SA... | F.....GNG.HV.H.G.R | ..DGE....DF....... | ...... | .SARG.D.AVDD | A..A........ | 0.03 | 5 |
| ..... | ................ | ................ | ...... | E.ASTA..A.GQ | A..A........ | 0.03 | 5 |
| A.... | ......ASA.S..T.T.G | .QPG.....NF......T | E..DD. | ............ | A..A........ | 0.03 | 5 |
| ..... | F................ | .V........F....... | ...... | ............ | TARNP..FER.T | 0.03 | 5 |
| NA... | F................ | ..AGR...........T | E..N.. | ............ | A..A........ | 0.03 | 5 |
| NA... | F.....A.A.RE.I.... | .K.T......F....... | ...N.. | ............ | A..A........ | 0.03 | 5 |
| RA... | F.....DAG.LL.T.A.G. | .QPG.....NF....... | ...NGR | ............ | A..A........ | 0.03 | 5 |
| GT... | F.....SG..IK.K.D.R | .QDT.....DF....... | ...... | ............ | A..A........ | 0.03 | 5 |
| ..... | F................ | .PPNG.....F......T | ...DDR | E.ATRA..A.DE | A..A........ | 0.03 | 5 |

TABLE 7-continued

AAV capsid proteins having increased specificity for and/or transduction of
CD44+ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ..... | ................ | ................. | ...ND. | ............ | A..A........ | 0.03 | 5 |
| ..... | ................ | ................. | ...D.. | ............ | ...A........ | 0.03 | 5 |
| D...T | ................ | ................. | E..ND. | ............ | A..A........ | 0.03 | 5 |
| ..... | F............... | ................. | ...... | EDAGGSDI.Y.S | A..A........ | 0.03 | 5 |
| ..... | F.....NQG.R..P.T.L | .Q.S......F......T | ...N.. | ............ | A..A........ | 0.03 | 5 |
| ..... | ................ | ................. | R...GR | .STGAD.....Q | A..A........ | 0.03 | 5 |
| GA... | ................ | ...T....NF......T | ...DDR | .SAKAA.AA.DE | A..A........ | 0.03 | 5 |
| NA... | F......KA.SA.T.A.G | .QAS......F......T | ...ND. | .NTGR..AA..Q | A..A........ | 0.03 | 5 |
| E.... | ................ | ................. | E..T.. | ............ | ............ | 0.03 | 5 |
| ..... | F............... | .V........F...... | ...... | ............ | GPRTH..DKA.. | 0.03 | 5 |
| ..... | F......GT.NM.L.Q.G | .Q.S......F...... | E..TD. | ............ | ............ | 0.03 | 5 |
| G.... | F.....STG.NP.M.E.R | ................. | ...... | ............ | A..A........ | 0.03 | 5 |
| RA... | ................ | TQ.TG....DF....... | ...DDR | E..RRD.AA..H | A..A........ | 0.03 | 5 |
| ..... | ................ | T.P......DF....... | G..D.F | .SGTAN.IEFGQ | A..A........ | 0.03 | 5 |
| ..... | ................ | ................. | ....G. | ............ | GNQT....TG.P | 0.03 | 5 |
| D...T | F.....GR..HD.L.N.L | ..DGE....DF....... | R...D. | ............ | ............ | 0.03 | 5 |
| ....T | F.....SA..RA.....R | TKDDW....DF....... | ...ND. | ............ | A..A........ | 0.03 | 5 |
| ..... | F............... | .V........F...... | ...... | ............ | .R.T...SDV.D | 0.03 | 5 |
| .A... | F.....NQA.SV...A.R | .QYT.....NF......T | E..DD. | ..AGAND.AY.N | A..A........ | 0.03 | 5 |
| NT... | F.....STA..Q.H.Q.L | T.PNE....DF....... | R...D. | .DAKRA..AV.E | A..A........ | 0.03 | 5 |
| RT... | ................ | .KYT.....NF......T | ...D.R | ............ | A..A........ | 0.03 | 5 |
| G...T | F.....NGG.NV.N.K.G | .QDT......F......T | ...D.. | ............ | ............ | 0.03 | 5 |
| ..... | F............... | .V........F...... | ...... | ............ | AARNG..FGT.D | 0.03 | 5 |
| .A... | ................ | ................. | ...D.. | .NTSTSD.E.DG | ............ | 0.03 | 5 |
| ..... | ......ASA.S..T.T.G | .QPG.....NF......T | E..DD. | ............ | A..A........ | 0.03 | 5 |
| NT..T | F.....SEA.IH...Q.L | .Q.DR.....F....... | ....D. | .NAGA.D...GS | A..A........ | 0.03 | 5 |
| ..... | F............... | .V........F...... | ...... | ............ | G.QSP..DGA.T | 0.03 | 5 |
| NA..T | F.....GKT.SL...G.R | ..DGE....DF....... | ...DG. | ..ATG..I.F.R | A..A........ | 0.03 | 5 |
| ..... | ................ | TQ.TG....DF....... | ...DDR | .S..RA.....G | A..A........ | 0.03 | 5 |
| ..... | F............... | .V........F...... | ...... | ............ | AERAT..ANN.E | 0.03 | 5 |
| TA... | F......QT.P..L.Q.R | TQP.R...NF......T | ...... | ............ | A..A........ | 0.03 | 5 |
| TA... | ................ | ..DNH....NF...... | ...D.. | .NGGTG..A.DR | A..A........ | 0.03 | 5 |
| GA... | ................ | ................. | ....GR | ..AG.N.AA.GQ | A..A........ | 0.03 | 5 |
| ..... | F............... | .V........F...... | ...... | ............ | GHHG...SGG.H | 0.03 | 5 |
| A...T | F............... | ................. | ...D.. | ..ASES.I..DG | A..A........ | 0.02 | 4 |
| NA..T | F.....GNG.HV.H.G.T | ................. | ...... | ............ | A..A........ | 0.02 | 4 |

TABLE 7-continued

AAV capsid proteins having increased specificity for and/or transduction of CD44+ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | F......RA.SQ.L.A.G | .........NF....... | R...D. | ..AGTSDIA.DR | A..A........ | 0.02 | 4 |
| ..... | F................. | .V........F....... | ...... | ........... | E.RS...F.E.H | 0.02 | 4 |
| ..... | ................. | ................. | ...D.. | .DADT..TE..H | A..A........ | 0.02 | 4 |
| AA... | F.....GGT.PM.K.D.R | ................. | ...... | ........... | GP.NA..YRE.Q | 0.02 | 4 |
| ..... | ................. | .V........F....... | ...... | ........... | ANSNP..SDS.Q | 0.02 | 4 |
| A.... | ................. | ................. | R..TG. | ........... | A..A........ | 0.02 | 4 |
| ..... | ................. | ................. | ....D. | ..AG...IA.GQ | A..A........ | 0.02 | 4 |
| GA... | ................. | .........NF....... | R...D. | .DGGGS.....G | A..A........ | 0.02 | 4 |
| EA... | F................. | .V........F....... | ...... | ........... | GPRNT..NST.A | 0.02 | 4 |
| G.... | F.....GA..SM.N.G.R | ..DGE....DF....... | ...... | ES.GAN..EVDG | A..A........ | 0.02 | 4 |
| ..... | F.....GTG..P.T.D.G | .QPG.....DF....... | ...D.. | ........... | A..A........ | 0.02 | 4 |
| ..... | F................. | .V........F....... | ...... | ........... | AQRDH..SEA.H | 0.02 | 4 |
| A.... | F.....GGG.NV.K.Q.G | T.YNH.....F....... | ...D.. | ........... | A..A........ | 0.02 | 4 |
| ..... | F................. | .V........F....... | ...D.. | ........... | ........... | 0.02 | 4 |
| ..... | ................. | ..........F......T | ...DDR | ENTSENDIE.DR | A..A........ | 0.02 | 4 |
| ..... | F................. | .V........F....... | ...... | ........... | TRKNP..VS..E | 0.02 | 4 |
| SA... | ................. | ................. | ...AGR | ........... | A..A........ | 0.02 | 4 |
| .A... | F.....SD..NP.H.D.R | ..YN......F......T | ...D.R | ENAGRAD.AFD. | A..A........ | 0.02 | 4 |
| TA..T | ................. | .Q.D.....DF..P.... | ...A.. | ........... | ........... | 0.02 | 4 |
| AA... | F......KT.NK...A.G | ..DGE....DF....... | ...... | E..G...D.AVGE | A..A........ | 0.02 | 4 |
| DT... | ................. | .QP.G.....F....... | ...DDR | ENGGR..IE..S | A..A........ | 0.02 | 4 |
| AA..T | F.....ANG.NV.L...G | .........NF......T | ...DG. | ........... | A..A........ | 0.02 | 4 |
| N.... | F.....DA..IA.L.K.R | TQ.TH....DF....... | R..ADS | ........... | A..A........ | 0.02 | 4 |
| D...T | G......SA.S..T.T.G | .QPG.....DF....... | ...DDR | ........... | ........... | 0.02 | 4 |
| ..... | ................. | ................. | ....GR | .DAT....A.GG | A..A........ | 0.02 | 4 |
| ..... | ................. | ................. | ...DDR | ESGS.S.IA.DQ | A..A........ | 0.02 | 4 |
| ..... | F................. | .V........F....... | ...... | ........... | GRQGG..S.V.E | 0.02 | 4 |
| ..... | ................. | .PHD.....DF......T | ...DG. | ........... | ........... | 0.02 | 4 |
| G.... | ................. | ................. | ...... | ESAREN.AE.DE | A..A........ | 0.02 | 4 |
| GG... | ................. | ................. | R..D.R | ........... | A..A........ | 0.02 | 4 |
| NT... | F.....SG..IK.K.D.R | TKDDR....DF....... | ...DDR | ........... | A..A........ | 0.02 | 4 |
| ..... | F................. | ................. | ...D.. | ........... | KERTP..ADT.. | 0.02 | 4 |
| ST..T | F.....G.T.II.P.D.R | ..HG.....NF....... | R..D.. | ..ASE....E.D | A..A........ | 0.02 | 4 |
| TA..T | F.....DQG.S......R | ..DGE....DF....... | ...DDR | .NAG.DD...DQ | A..A........ | 0.02 | 4 |
| ..... | ................. | .KYT.....NF......T | ...AD. | ........... | A..A........ | 0.02 | 4 |
| RA... | F......TG..Q.T.T.G | .Q.......DF....... | ...AD. | ........... | A..A........ | 0.02 | 4 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | F.....NGG.NN.K.T.R | T.P......DF....... | ...DDR | E..G.A..E.GR | A..A........ | 0.02 | 4 |
| G.... | F.....NTG.LH.T...R | ..PN.....NF....... | ...D.. | E........... | A..A........ | 0.02 | 4 |
| ..... | F.....NG..H..I.A.R | ................. | ...... | ............ | A..A........ | 0.02 | 4 |
| ..... | F.....DH..ID.K...V | ................. | ...... | ..AG.DD...GG | A..A........ | 0.02 | 4 |
| ..... | ................. | ................. | ...DDR | ESGGTD....DR | A..A........ | 0.02 | 4 |
| A.... | F.....DAA.IA.L.K.R | .PPNG.....F......T | ...DD. | ............ | A..A........ | 0.02 | 4 |
| G.... | F................ | ..HG.....NF......T | ...A.. | ............ | A..A........ | 0.02 | 4 |
| ..... | ................. | ................. | R..KD. | ............ | A..A........ | 0.02 | 4 |
| ..... | F.....NN..SA.N...R | T.P......DF....... | ...D.. | E.TTG.DAE.DN | A..A........ | 0.02 | 4 |
| AA... | ................. | .V........F....... | ...... | ............ | A..A........ | 0.02 | 4 |
| EA... | ................. | ................. | ...D.. | ............ | A..A........ | 0.02 | 4 |
| ..... | ......G....K.L...G | TKDDR....DF....... | ...... | ............ | A..A........ | 0.02 | 4 |
| ..... | ................. | ................. | E..ND. | ...G.D..EVGQ | A..A........ | 0.02 | 4 |
| NA..T | F.....GTG..P.T.D.R | .QPSE....DF....... | ...DDR | ............ | ............ | 0.02 | 4 |
| ..... | F.....NT.....K.A.R | .V........F....... | ...... | ............ | ............ | 0.02 | 4 |
| RA... | F.....SS..RA.....R | T.P......DF....... | ...D.. | E.AG.DDA...R | A..A........ | 0.02 | 4 |
| ..... | ................. | ................. | R...DR | .NGG.S..G..S | A..A........ | 0.02 | 4 |
| GA... | ................. | ................. | G..ND. | ED.A.G.T..DN | A..A........ | 0.02 | 4 |
| ..... | ................. | ................. | ...... | .D...S..A.GG | A..A........ | 0.02 | 4 |
| G.... | F......GG.NV...G.M | ................. | ...DD. | ............ | A..A........ | 0.02 | 4 |
| AA... | F.....SA..RA.....R | ................. | G..ND. | ............ | A..A........ | 0.02 | 4 |
| ..... | ................. | ...NG....NF......T | G..TG. | ............ | A..A........ | 0.02 | 4 |
| ET..T | ................. | ..HG.....NF......T | ...N.. | E.AG...IAVDR | A..A........ | 0.02 | 4 |
| ..... | F................ | .V........F....... | ...... | ............ | .R.NG..Y.G.D | 0.02 | 4 |
| ..... | ................. | .........NF....... | R...D. | .DGAGGD.A..Q | A..A........ | 0.02 | 4 |
| ....T | ................. | .KDSR....DF....... | ...D.. | ............ | A..A........ | 0.02 | 4 |
| ..... | F................ | .V........F....... | ...... | ............ | .P.GT..STT.A | 0.02 | 4 |
| ..... | F................ | .QPSE....DF....... | ...AGR | ED.A.A.T..DR | A..A........ | 0.02 | 4 |
| ..... | F................ | .V........F....... | ...... | ............ | GP.GA..VQE.. | 0.02 | 4 |
| GT... | ................. | ................. | ...... | ..AG.D..E.GG | A..A........ | 0.02 | 4 |
| GT... | ................. | T.PTG....DF....... | ...DDR | .DAG.A.I..DG | A..A........ | 0.02 | 4 |
| SA... | F.....GN..NA.T...M | TQ.TG............ | ...... | E..K.GDA...S | A..A........ | 0.02 | 4 |
| SA... | ...............T.L | .Q.S......F......T | ...N.. | ............ | A..A........ | 0.02 | 4 |
| RT... | F................ | ................. | ...D.. | .N.AGNDAAVDE | A..A........ | 0.02 | 4 |
| GA..T | ................. | ................. | ...D.R | E.AG..D.A.GR | A..A........ | 0.02 | 4 |
| ..... | F.....NGG.NN.K.T.R | TQYDR....NF....... | R...D. | ............ | A..A........ | 0.02 | 4 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| E.... | ................. | ................. | ...AGR | .N.NRN.....G | A..A........ | 0.02 | 4 |
| ..... | F.....AQ...A.L.... | TKDDR....DF....... | ...DDR | ..AG..D.A.GR | A..A........ | 0.02 | 4 |
| ..... | F................. | .V........F....... | ...... | ............ | KSKAA..V.S.D | 0.02 | 4 |
| TA... | F.....ASA.S..T.T.G | .QPG.....DF....... | ...DDR | ............ | ............ | 0.02 | 4 |
| ..... | F.....SGA..K.S.S.S | ..A......DF....... | ...... | ............ | ANRTA..DKA.. | 0.02 | 4 |
| ..... | F................. | .V........F....... | ...... | ............ | TRRGP..DRI.E | 0.02 | 4 |
| ..... | ................. | .........NF......T | R..AG. | .STGAD.....Q | A..A........ | 0.02 | 4 |
| E.... | F.....SN..PL.K.T.. | .........F..P.... | R..... | ............ | ............ | 0.02 | 4 |
| ....T | ................. | .KYT.....NF......T | ...DDR | ............ | A..A........ | 0.02 | 4 |
| DA... | ................. | .KYT.....NF......T | R..ND. | ............ | A..A........ | 0.02 | 4 |
| ..... | ................. | ...T.....NF......T | ...ADR | E..RRD.AA..H | A..A........ | 0.02 | 4 |
| E.... | F.....AG..RE.L...K | .QPN......F......T | ...N.. | ESGG.G..E..Q | A..A........ | 0.02 | 4 |
| ..... | ................. | .........NF....... | E..KG. | ............ | A..A........ | 0.02 | 4 |
| GA..T | F.....SNG.P....T.R | ..A......DF....... | ...DG. | ............ | A..A........ | 0.02 | 4 |
| EA... | ................. | TQHTG....NF....... | ...DDR | ............ | A..A........ | 0.02 | 4 |
| N.... | F.....A...ND.T...K | .QD......DF..P.... | G..K.. | E.GG.....FD. | A..A........ | 0.02 | 4 |
| ..... | ................. | ..HG.....NF......T | ...A.. | .SAKAA.AA.DE | A..A........ | 0.02 | 4 |
| .T... | F................. | .V........F....... | ...... | ............ | SERAG..YQ..Q | 0.02 | 4 |
| TA..T | F.....DNG.SP.I.N.R | ..HG.....NF......T | ...A.. | ............ | ............ | 0.02 | 4 |
| HA... | F.....GKG.ND.T.N.G | ..A......DF....... | ...DG. | ............ | A..A........ | 0.02 | 4 |
| ..... | F...........H.... | .V........F....... | ...... | ............ | DQRNS..ARN.T | 0.02 | 4 |
| ..... | ................. | ................. | ...... | .DGTG..A..GN | A..A........ | 0.02 | 4 |
| ..... | F................. | TKAT.....NF......T | ...... | .SGR.N.T..GD | A..A........ | 0.02 | 4 |
| ..... | ................. | ................. | ...N.. | ...G.N.A.... | A..A........ | 0.02 | 4 |
| ET..T | F.....ANG.HL.K.K.S | .........F......T | G..N.. | ............ | A..A........ | 0.02 | 4 |
| ..... | F.....NGG.NN.K.T.R | ..A......DF....... | ...DG. | ESGG.S..E.GD | A..A........ | 0.02 | 4 |
| .A... | ................. | ................. | R..DD. | ............ | A..A........ | 0.02 | 4 |
| ..... | F.....A.A.RE.I.... | .Q.S......F....... | E..NG. | ............ | A..A........ | 0.02 | 4 |
| R.... | ................. | .........KF..P...T | R...D. | .SAKAA.AA.DE | A..A........ | 0.02 | 4 |
| ..... | ................. | ..AGR....NF....... | ...NDR | ............ | ............ | 0.02 | 4 |
| AA... | F......GG.NV...K.. | .PPNG.....F......T | ...DDR | ............ | A..A........ | 0.02 | 4 |
| GT... | ......AEG.LK.M.H.L | ..DGE....DF....... | ...... | ............ | A..A........ | 0.02 | 4 |
| E.... | ................. | .V........F....... | ...DDR | E.GAEGD..FDG | ............ | 0.02 | 4 |
| ..... | ................. | ................. | ...D.R | ..TAE...E..E | A..A........ | 0.02 | 4 |
| GT... | ................. | TQPGG............ | ...DDR | E..AAND...GG | A..A........ | 0.02 | 4 |
| N.... | F.....GRT.PQ.T.T.R | ..DGE....DF....... | ...... | E.ARRA.AE.D. | A..A........ | 0.02 | 4 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | F.....NG..SN.M...K | ...G.....DF....... | G..ADR | .NAA.A....GD | A..A........ | 0.02 | 4 |
| .T..T | F.....AG..RV.L.N.G | .V........F....... | ...... | E..AAS....GG | A..A........ | 0.02 | 4 |
| ..... | .................. | .................. | E..KG. | .......I..G. | A..A........ | 0.02 | 4 |
| N.... | F.....DRG.S..T.A.S | ..DGE....DF....... | ...... | ............ | ............ | 0.02 | 4 |
| RA... | F................. | .V........F....... | ...... | ............ | GRRSP......A | 0.02 | 4 |
| ..... | F................. | .................. | R..TG. | ............ | A..A........ | 0.02 | 4 |
| A.... | F................. | ..............F... | R...D. | ............ | ............ | 0.02 | 4 |
| DA... | F.....GKG.ND.T.N.R | .V........F....... | ...... | ENGGTN..E.GN | A..A........ | 0.02 | 4 |
| ..... | F................. | .V........F....... | ...... | ............ | DR.NA..F.G.. | 0.02 | 4 |
| G...T | F.....G.T.IN.T...H | .QPG.....NF....... | ...DDR | ............ | A..A........ | 0.02 | 4 |
| GT... | F.....DRG.S..T.A.S | ..DGE....DF....... | ...... | ............ | A..A........ | 0.02 | 4 |
| ..... | .................. | ................T | ...D.. | .D..RND.A..S | A..A........ | 0.02 | 4 |
| ..... | .................. | .................. | ....D. | E.GGGA.AEVGD | A..A........ | 0.02 | 4 |
| ..... | .................. | .................. | ....D. | .DAG.S.A..DR | A..A........ | 0.02 | 4 |
| E.... | ......ASA.S..T.T.G | .QPG.....NF......T | E..DD. | ............ | A..A........ | 0.02 | 4 |
| ..... | F.....NTT.IL.T.T.K | .QPNG....DF....... | R..DD. | E.AR..DAE.DN | A..A........ | 0.02 | 4 |
| ..... | .................. | .................. | R..DD. | ESGSES.IA..D | A..A........ | 0.02 | 4 |
| R.... | F.....ATG.NV.T.G.R | ..ATR....DF....... | E..N.. | ............ | A..A........ | 0.02 | 4 |
| SA... | F.....S.G.RQ.T.E.R | .QD.E.....F..P.... | .....R | ............ | A..A........ | 0.02 | 4 |
| SA... | .................. | ..A.......DF....... | ...DG. | .SGS.N..AV.D | A..A........ | 0.02 | 4 |
| ET..T | ......ANG.HL.K.K.S | .........DF......T | G..N.. | ............ | A..A........ | 0.02 | 4 |
| E.... | F.....ASA.S..T.T.G | .QD.E.....F..P.... | ...DDR | ............ | ............ | 0.02 | 4 |
| SA..T | .................. | ..............F... | ...... | ............ | DRSGA...RS.A | 0.02 | 4 |
| ..... | .................. | ...........DF......T | E..ND. | ............ | A..A........ | 0.02 | 4 |
| R.... | F.....GA..SM.N.G.R | ..DGE....DF....... | ...... | ES.GAN..EVDG | A..A........ | 0.02 | 4 |
| G.... | .................. | ..HG.....NF......T | ...A.. | E.TSGGD.E..Q | A..A........ | 0.02 | 4 |
| ..... | F................. | .................. | ...D.. | ............ | A..A........ | 0.02 | 4 |
| .A... | .................. | .QPN......F......T | ...N.. | ..TG.D..A.GG | A..A........ | 0.02 | 4 |
| ..... | .................. | .................. | G..DG. | ............ | A..A........ | 0.02 | 4 |
| K.... | F.....GNG.HV.H.G.R | .................. | ...DD. | ............ | A..A........ | 0.02 | 4 |
| DA... | .................. | .................. | ...DDR | ESGST.DAA.GQ | A..A........ | 0.02 | 4 |
| ..... | .................. | .Q.S......F....... | ....D. | ............ | ............ | 0.02 | 4 |
| ..... | F.....NGG.LN.I.G.R | TKPDR....NF......T | ...... | ............ | A..A........ | 0.02 | 4 |
| ..... | F................. | .V........F....... | ...... | ............ | T.HD...YHS.Q | 0.02 | 4 |
| ..... | F................. | .V........F....... | ...... | ............ | DKRTP..DRR.E | 0.02 | 4 |
| ..... | .................. | .................. | ...... | .S.ATGDTE.DG | A..A........ | 0.02 | 4 |

TABLE 7-continued

AAV capsid proteins having increased specificity for and/or transduction of CD44$^+$ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ....T | ................. | ..AGR.....F......T | ....D. | ............ | A..A........ | 0.02 | 4 |
| ...S. | ................. | ................. | ...... | ............ | ............ | 0.02 | 4 |
| R.... | F.....NGG.NN.K.T.R | .........NF....... | R...D. | .DTG.GD.A..H | A..A........ | 0.02 | 4 |
| ..... | F.....DTG.PA.L.T.K | .........NF....... | R...D. | ..ASGD....GR | A..A........ | 0.02 | 4 |
| ..... | ................. | ................T | ...ADR | E..GR..IAFDG | A..A........ | 0.02 | 4 |
| NA... | F.....DRG.S..T.A.S | ..DGE....DF....... | ...... | ............ | ............ | 0.02 | 4 |
| ..... | ................. | .............NF....... | E..A.. | E..G.SDAA.GD | A..A........ | 0.02 | 4 |
| ..... | F................. | .V........F....... | ...... | ............ | NTRSG..AK..H | 0.02 | 4 |
| ..... | F................. | .V........F....... | ...... | ............ | AAQS...NTA.T | 0.02 | 4 |
| G.... | F................. | .V........F....... | ...... | ............ | SRSGR...E..P | 0.02 | 4 |
| E.... | ................. | .QPN......F......T | ...N.. | E.AGAND.AV.H | A..A........ | 0.02 | 4 |
| .A... | F................. | .V........F....... | ...DG. | ............ | ............ | 0.02 | 4 |
| ..... | ................. | ..YN......F......T | ...D.R | ............ | A..A........ | 0.02 | 4 |
| ..... | F................. | .V........F....... | ...... | ............ | NPRDP..NNG.. | 0.02 | 4 |
| ..... | ................. | .QPN......F......T | ...N.. | ..TG.D..A.GG | A..A........ | 0.02 | 4 |
| NA..T | F................. | ................. | ...DD. | ..ASTDDA.VGE | A..A........ | 0.02 | 4 |
| ..... | ................. | ...V.....NF....... | R...D. | ............ | A..A........ | 0.02 | 4 |
| ..... | ................. | .Q.......DF....... | ....D. | E.AG.GDIAYGD | A..A........ | 0.02 | 4 |
| ..... | ................. | ................. | ...DDR | E.A.G..A...N | A..A........ | 0.02 | 4 |
| ..... | ................. | ................. | ...D.R | ESGT.A.A..GH | A..A........ | 0.02 | 4 |
| ..... | F................. | .V........F....... | ...... | ............ | KRHDG..SHM.E | 0.02 | 4 |
| TA... | F.....DRG.S..T.A.S | ..DGE....DF....... | ...... | ............ | ............ | 0.02 | 4 |
| A...T | ................. | ...V.....NF....... | R...D. | ............ | A..A........ | 0.02 | 4 |
| GT... | ................. | .QPDR.....F......T | ...... | ..TTGND..VDG | A..A........ | 0.02 | 4 |
| ..... | F................. | .V........F....... | ...... | ............ | GARNP..ATA.E | 0.02 | 4 |
| ..... | F.....GDT..L.....R | ..HG.....NF......T | ...D.. | ESGGGGDT.V.G | A..A........ | 0.02 | 4 |
| ..... | F.....DTG.SK.T.T.R | .QDT......F......T | ...D.. | ............ | A..A........ | 0.02 | 4 |
| RA... | F.....DTG.SK.T.T.R | .Q.S......F....... | ...D.. | .NGR.G..A..E | A..A........ | 0.02 | 4 |
| ..... | F................. | .V........F....... | ...... | ............ | SSRSG..AGN.T | 0.02 | 4 |
| ..... | ......DKA.IK.K.S.G | .QPN......F......T | ...N.. | E.TAG.DI..D | A..A........ | 0.02 | 4 |
| A.... | F.....GQ..RV.T...L | .A.......DF....... | ...DG. | ............ | A..A........ | 0.02 | 4 |
| ..... | F.....GN..RM.T...E | .HG......NF......T | ...A.. | E.AG...IA.DD | A..A........ | 0.02 | 4 |
| G.... | ................. | TKAT.....NF......T | G..TG. | ............ | A..A........ | 0.02 | 3 |
| ..... | ................. | .PHD.....DF......T | ...DG. | .NTGGG....DG | A..A........ | 0.02 | 3 |
| A.... | ................. | .QANH.....F......T | R..A.. | E..A.ADA..GD | A..A........ | 0.02 | 3 |
| ..... | ................. | ................T | ...ADR | E.GTEGDIA..D | A..A........ | 0.02 | 3 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ....T | F.....GAT.LA.M.H.R | .........NF....... | R...D. | ............ | A..A........ | 0.02 | 3 |
| ..... | ................. | ...............T | ...AGR | ............ | A..A........ | 0.02 | 3 |
| SA... | F.....GHG.NK.I.N.T | ..PSH....DF....... | ....D. | ............ | A..A........ | 0.02 | 3 |
| DT... | F.....AQ...A.L.... | .QPN......F......T | ....N. | E.AG.A..EF.R | A..A........ | 0.02 | 3 |
| NA... | F.....DR.......H.V | ..DGE....DF....... | ...... | ............ | A..A........ | 0.02 | 3 |
| R.... | F.....NKT.I..K..... | ..DGE....DF....... | ...... | E.AGAADA.VDH | A..A........ | 0.02 | 3 |
| NT..T | ................. | ................. | ...... | .DTAAA...VGE | A..A........ | 0.02 | 3 |
| ..... | ................. | ...............T | E..AD. | ............ | A..A........ | 0.02 | 3 |
| ..... | ................. | .V........F....... | ...... | ............ | GPQGR..SR..A | 0.02 | 3 |
| ..... | ................. | .QPSE....DF....... | ...AGR | ED.A.A.T..DR | A..A........ | 0.02 | 3 |
| ..... | ................. | ........DF....... | ...DG. | ..TG.A.I..DR | A..A........ | 0.02 | 3 |
| ..... | ................. | ..........F....... | ....D. | ............ | ............ | 0.02 | 3 |
| AA... | ................. | ..DGE....DF....... | R...D. | ............ | ............ | 0.02 | 3 |
| SA..T | F.....DKA.PD.K.A.R | ..A.R....DF....... | ...D.. | .DAG.GD.AY.Q | A..A........ | 0.02 | 3 |
| ..... | ................. | ................. | ...DD. | .DTA.A.AA.GE | A..A........ | 0.02 | 3 |
| ..... | F................. | .V........F....... | ...... | ............ | SRHGG..FTE.T | 0.02 | 3 |
| ..... | F................. | .V........F....... | ...... | ............ | TTRTT..VTN.H | 0.02 | 3 |
| ..... | F................. | .V........F....... | ...... | ............ | .PRDA..V.I.. | 0.02 | 3 |
| ..... | F................. | .V........F....... | ...... | ............ | SNRAG..N.G.T | 0.02 | 3 |
| ..... | ................. | ................. | ....G. | ............ | A..A........ | 0.02 | 3 |
| ..... | ................. | ................. | R..DD. | ..TG.N.IAF.D | A..A........ | 0.02 | 3 |
| GT... | F.....NRA.LA.N.K.E | ..DGE....DF....... | ....D. | ..AG.N.AA.GQ | A..A........ | 0.02 | 3 |
| TA... | ................. | .Q.GQ....DF....... | ....G. | ENAGASDIA.DH | A..A........ | 0.02 | 3 |
| ..... | ................. | ................. | R..NDR | E.AG..D.A.GR | A..A........ | 0.02 | 3 |
| ..... | F................. | .V........F....... | ...... | ............ | ..RAP..FSE.. | 0.02 | 3 |
| ..... | ................. | ...NE.....F....... | R..N.. | E.AKGSDA.FDN | A..A........ | 0.02 | 3 |
| ..... | ................. | .QANH.....F......T | R...G. | ..ASTDDA.VGE | A..A........ | 0.02 | 3 |
| TA..T | F.....DQG.S..L...G | ..P.G....KF....... | ...DDR | .NAG.DD...DQ | A..A........ | 0.02 | 3 |
| .A... | ................. | .K.TG....DF....... | R...DR | ESAN...I...H | A..A........ | 0.02 | 3 |
| ..... | ................. | ................. | ...DD. | ESGNR.D.EV.D | A..A........ | 0.02 | 3 |
| ..... | F................. | ................. | ...... | ............ | GTRGT..ADA.Q | 0.02 | 3 |
| ..... | ................. | TKDDR....DF....... | ...DDR | .D...A..AVDD | A..A........ | 0.02 | 3 |
| A.... | F.....GG..I.P...R | ................. | ...... | ..........GE | A..A........ | 0.02 | 3 |
| ..... | ................. | ................. | ...N.. | .S.G.S.IA..G | A..A........ | 0.02 | 3 |
| E.... | ................. | .QANH.....F......T | R..D.. | .SAKAA.AA.DE | A..A........ | 0.02 | 3 |
| ..... | F................. | .V........F....... | ...... | ............ | SRQNA..S...K | 0.02 | 3 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | F................. | .................T | G..TDR | E.AGGN..E.DD | ............ | 0.02 | 3 |
| SA... | F.....ASA.S..T.T.G | .QPG.....DF....... | ...DDR | ............ | ............ | 0.02 | 3 |
| ..... | F................. | .V........F....... | ...... | ............ | GT.TG..DKG.Q | 0.02 | 3 |
| ..... | ................. | ................. | ...... | ..TNESD..... | A..A........ | 0.02 | 3 |
| S.... | ................. | ................. | ...... | .DTA.A.AA.GE | A..A........ | 0.02 | 3 |
| E.... | ................. | ................. | E..AG. | ............ | ............ | 0.02 | 3 |
| .A... | F.....DGA.RN.T.S.G | ..HG.....NF....... | ...D.. | ............ | A..A........ | 0.02 | 3 |
| TA... | ................. | .KDSR....DF....... | R..DD. | ..AAE.D....N | A..A........ | 0.02 | 3 |
| ..... | ................. | ................. | G..KGR | ............ | A..A........ | 0.02 | 3 |
| SA..T | ................. | .PPNG.....F......T | ...DDR | ............ | A..A........ | 0.02 | 3 |
| ..... | F................. | ................. | ...D.R | E.AG..D.A.GR | A..A........ | 0.02 | 3 |
| ..... | F................. | ................. | ...NGR | ..ASAAD.E..D | A..A........ | 0.02 | 3 |
| G.... | F.....DGG.NK.T...L | .Q.DR.....F....... | ...DDR | EDGG.S..E.DR | A..A........ | 0.02 | 3 |
| ..... | ................. | .KD.E.....F......T | ...DDR | ENAKT.DAEFGQ | A..A........ | 0.02 | 3 |
| TA... | F.......T.SV...H.R | TQ.TG....DF....... | ...DDR | ............ | A..A........ | 0.02 | 3 |
| ..... | ................. | ................T | ...TGR | ............ | A..A........ | 0.02 | 3 |
| ..... | F................. | .V........F....... | ...... | ............ | ARSNR..FDV.H | 0.02 | 3 |
| ..... | ................. | ..DGE....DF....... | ...... | ED.A.G.T..DN | A..A........ | 0.02 | 3 |
| ..... | ................. | ..........F....... | R...DR | E.ATEN..EFDS | A..A........ | 0.02 | 3 |
| ..... | F................. | .V........F....... | ...... | ............ | ARSSA..VEM.E | 0.02 | 3 |
| DT... | F......TG.IL...T.R | .QPG.....NF....... | ...... | E.TA.S..EY.. | A..A........ | 0.02 | 3 |
| DA... | F......NG.LQ.H...N | T.P......DF....... | ...D.. | ............ | ............ | 0.02 | 3 |
| EA... | ................. | ................. | ...AD. | ............ | ............ | 0.02 | 3 |
| ....T | F......GRG.H.P.E.R | .Q.......DF....... | ...AD. | ............ | A..A........ | 0.02 | 3 |
| G.... | F......DK..P.M.T.R | .QPN......F......T | ...N.. | ESATGG.T..GG | A..A........ | 0.02 | 3 |
| GT... | ................. | T.AG......F......T | ...DD. | .SAKAA.AA.DE | ............ | 0.02 | 3 |
| ..... | F.....GRG.H..P.E.R | .V........F....... | R..A.. | ............ | A..A........ | 0.02 | 3 |
| A.... | F.....DD..IH.K.K.K | .Q.DR.....F....... | ....D. | ..AT..DIA.DR | A..A........ | 0.02 | 3 |
| GT... | ................. | ................. | G..N.. | ............ | ............ | 0.02 | 3 |
| D...T | ................. | ................. | ....GR | ..AG.N.AA.GQ | A..A........ | 0.02 | 3 |
| ..... | F................. | .V........F....... | ...... | ............ | GPRAP..SET.Q | 0.02 | 3 |
| ..... | F.....NKT.I..K.... | ..DGE....DF....... | ...... | E.AGAADA.VDG | A..A........ | 0.02 | 3 |
| .A... | ................. | ..YN......F......T | R..DDR | .SARTGDTA..G | A..A........ | 0.02 | 3 |
| DT... | F.....AR..SL...H.G | ..YN......F......T | ...D.R | ............ | A..A........ | 0.02 | 3 |
| R.... | ................. | ................. | R...DR | E.ATEN..EFDS | A..A........ | 0.02 | 3 |
| ..... | F................. | .QPN......F......T | ...DD. | ..TGAS..EV.N | A..A........ | 0.02 | 3 |

TABLE 7-continued

AAV capsid proteins having increased specificity for and/or transduction of CD44+ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ..... | ................. | .................. | ...... | EDGAGD..E..R | A..A........ | 0.02 | 3 |
| ..... | F......NG.LQ.H...N | T.P......DF....... | ...D.. | ............ | ............ | 0.02 | 3 |
| ..... | F................. | .V.........F...... | ...... | ............ | GARSS...EI.K | 0.02 | 3 |
| ..... | F.....SN...P.H.T.K | .V........F...... | ...... | ............ | ............ | 0.02 | 3 |
| GT... | F................. | .Q.S.....DF...... | ...DD. | ES.G.AD.EFGE | A..A........ | 0.02 | 3 |
| ..... | F................. | .................. | ....GR | ............ | A..A........ | 0.02 | 3 |
| .A... | ................. | ..DDG....NF..P.... | R..DD. | ENGKE..I..DG | A..A........ | 0.02 | 3 |
| AT... | F.....DGT.SM.N.G.R | .KDDG...NF......T | E..AG. | ............ | ............ | 0.02 | 3 |
| ..... | ................. | TQDDR....DF....... | ...DDR | E.TR.N.....Q | A..A........ | 0.02 | 3 |
| G.... | ................. | .................. | R..AG. | ............ | A..A........ | 0.02 | 3 |
| .A... | F.....GKA.LD.P.D.R | ..PN.....NF....... | ...... | ............ | A..A........ | 0.02 | 3 |
| .A... | ................. | .KD.E.....F....... | ...N.. | ............ | ............ | 0.02 | 3 |
| G.... | F.....SA..RA.....R | ..DGE....DF....... | ...DDR | E.TGGSD.E..R | A..A........ | 0.02 | 3 |
| ..... | ................. | .................. | ...D.R | ESATGG.T..GG | A..A........ | 0.02 | 3 |
| EA... | F....SA..SM.M.T.K | TKASG.....F....... | ...DDR | E.AGAND.AY.N | A..A....... | 0.02 | 3 |
| ..... | ................. | .................. | R..DD. | ED.NGN.IA.D. | A..A........ | 0.02 | 3 |
| ..... | F.....DRG.S..T.A.S | ..DGE....DF....... | ...... | ............ | A..A........ | 0.02 | 3 |
| DT... | F.....SG..RV.I.G.R | .V........F....... | R..... | ESGG.G..E..Q | A..A........ | 0.02 | 3 |
| .A... | F.....NGG.NN.K.T.R | .QHNQ.....F......T | ...N.. | ............ | A..A........ | 0.02 | 3 |
| ..... | ................. | ..AS.....DF....... | ...N.. | ..GTAG...V.G | A..A........ | 0.02 | 3 |
| H.... | F.....SGT.SQ.K.E.. | .Q.......DF....... | ...DDR | ............ | A..A........ | 0.02 | 3 |
| RA... | F................. | .................. | E..N.. | ............ | A..A........ | 0.02 | 3 |
| HA... | F.....ATT.NV.T.K.S | .Q.DR.....F....... | ....D | E.TGAN.AE.GE | A..A........ | 0.02 | 3 |
| E.... | ................. | .................. | E..TG. | ............ | ............ | 0.02 | 3 |
| .T... | F.......T.SV...H.R | ...TE.....F......T | ...... | E.AAASDAAY.N | A..A........ | 0.02 | 3 |
| E.... | F.....DRG.S..T.A.S | .V........F....... | ...... | ............ | G.RAG..DTE.Q | 0.02 | 3 |
| ..... | F................. | .V........F... | ...... | ............ | TTSGP...QK.. | 0.02 | 3 |
| .T... | F.....AGG.IV.L.G.R | TKDDR....DF....... | ...DDR | EDAGRND.AFDH | A..A........ | 0.02 | 3 |
| ..... | ................. | .................. | G...GR | .SGS.NDIA..D | A..A........ | 0.02 | 3 |
| ..... | ................. | .................. | E..NG. | ..ANR.D...DR | A..A........ | 0.02 | 3 |
| ..... | ................. | .................. | E..KG. | ............ | A..A........ | 0.02 | 3 |
| ..... | F.....ASA.S..T.T.G | .QPG.....DF....... | E..T.. | ............ | ............ | 0.02 | 3 |
| ..... | F.....ST...D.I...S | .QPG.....DF....... | ...DDR | ............ | A..A........ | 0.02 | 3 |
| EA..T | ................. | .................. | ...D.. | .DGA.....VGR | A..A........ | 0.02 | 3 |
| ..... | F.....SG..IQ.M.Q.R | .QYSR....NF....... | R..D.. | E.AG..D.A.GR | A..A........ | 0.02 | 3 |
| ..... | ................. | .................. | ...... | .DGNGA.I.V.G | A..A........ | 0.02 | 3 |

TABLE 7-continued

AAV capsid proteins having increased specificity for and/or transduction of CD44+ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| GT... | F.....SG..IK.K.D.R | .Q.G.....NF......T | ...NGR | ............ | A..A........ | 0.02 | 3 |
| ..... | .................. | .................. | ....D. | E.GGA.D.AV.E | A..A........ | 0.02 | 3 |
| TA... | F................. | .V........F....... | ...... | ............ | GPRAS..VNV.P | 0.02 | 3 |
| ..... | .................. | ..........DF...... | ...DDR | ESAGAG..A.GR | A..A........ | 0.02 | 3 |
| E.... | F.....SK..PA.K.A.G | .V........F....... | ...... | .DGGGN.....R | A..A........ | 0.02 | 3 |
| ..... | .................. | .................. | ...DG. | ESGGRA..EV.S | A..A........ | 0.02 | 3 |
| ..... | .................. | .................. | ...D.. | .DGKTGD..VGE | A..A........ | 0.02 | 3 |
| D.... | F.....GQ..LN.L.D.R | ..HG.....NF......T | G..KD. | ............ | A..A........ | 0.02 | 3 |
| .T... | .................. | .V........F....... | ...... | ............ | KERSP..I.T.. | 0.02 | 3 |
| ..... | F................. | .V........F....... | ...... | ............ | TTHST..FET.D | 0.02 | 3 |
| .A... | F.....NA..HE.L.G.R | T.P......DF...... | ...D.. | ............ | ............ | 0.02 | 3 |
| ..... | .................. | ..HG.....NF......T | ...... | E........... | A..A........ | 0.02 | 3 |
| G...T | F.....DQ..R..P.S.R | .Q.S......F....... | ...D.. | ............ | A..A........ | 0.02 | 3 |
| ..... | .................. | ..........F....... | ....D. | ESTGT..AAV.Q | A..A........ | 0.02 | 3 |
| ..... | .................. | .................. | ....G. | .SGS.NDIA..D | A..A........ | 0.02 | 3 |
| ..... | F................. | .V........F....... | ...... | ............ | TEHNP..FRS.T | 0.02 | 3 |
| SA... | F......KT.NV.K.T.G | TKPS.....DF......T | R..N.. | ............ | A..A........ | 0.02 | 3 |
| ..... | F......KT.NK...A.G | T.PGG....NF....... | ...DD. | .SAKAA.AA.DE | A..A........ | 0.02 | 3 |
| ..... | ..........A.N...R | .KYT.....NF......T | R...D. | ...G.D..EVGQ | A..A........ | 0.02 | 3 |
| S.... | F.....S...NV...T.. | TQDGE....DF....... | ...DG. | ............ | A..A........ | 0.02 | 3 |
| ..... | .................. | .................. | ...D.R | ..GAAND....H | A..A........ | 0.02 | 3 |
| N.... | F.....SD..HP.L.Q.K | .KYTE.....F....... | E..TGR | ............ | ............ | 0.02 | 3 |
| NA... | .................. | .................. | ...... | E.TDA...AVDQ | ............ | 0.02 | 3 |
| AA... | ......DHT..D.P...R | ...NG.....F....... | R...D. | EDAR.D..EVGE | A..A........ | 0.02 | 3 |
| DT... | .................. | .................. | R..DD. | ............ | A..A........ | 0.02 | 3 |
| SA... | F.....ASA.S..T.T.G | .Q.S......F....... | ....D. | ............ | ............ | 0.02 | 3 |
| NT..T | F.....AHT.LK.N...G | ..YN......F......T | ...D.R | ..TK...AE..D | A..A........ | 0.02 | 3 |
| ..... | F................. | .................. | R...D. | ............ | A..A........ | 0.02 | 3 |
| D.... | F......GT.NM.L.Q.G | .Q.S......F....... | ....D. | ............ | ............ | 0.02 | 3 |
| NA... | .................. | TQ..H....NF......T | ...D.. | ............ | A..A........ | 0.02 | 3 |
| HT..T | F.....GS..NM.N.T.R | TQPG.....NF....... | R..ND. | ............ | A..A........ | 0.02 | 3 |
| ..... | .................. | .................T | ...N.. | .DTSANDT..DG | A..A........ | 0.02 | 3 |
| A.... | F......G..NQ.N.A.G | TKAT.....NF......T | ...DDR | ............ | A..A........ | 0.02 | 3 |
| ..... | F................. | .V........F....... | ...... | ............ | ADHT...V.A.Q | 0.02 | 3 |
| GA... | F.....GTT....M.T.L | .K.TQ.....F....... | ...DDR | ...D.D..E..G | A..A........ | 0.02 | 3 |
| TA... | F.....AKG.P..H...G | .Q.S......F....... | E..N.. | ............ | A..A........ | 0.02 | 3 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | .................. | .PPNG.....F....... | ...DDR | ........... | ............ | 0.02 | 3 |
| E.... | F.....A...ND.T...K | .KDSR....DF....... | R..D.. | .STA..DA.FDS | A..A........ | 0.02 | 3 |
| ..... | .................. | ..........F | R...D. | EN.KA.DAE..D | A..A........ | 0.02 | 3 |
| HT..T | .................. | .QPTG....NF....... | R..DG. | ..AATNDAEF.E | A..A........ | 0.02 | 3 |
| GA... | F................. | .V........F....... | ....GR | ..AG.N.AA.GQ | A..A........ | 0.02 | 3 |
| ..... | F................. | .V........F....... | ...... | ........... | T.RDG..ITG.T | 0.02 | 3 |
| SA... | F.....S.T..I.K.N.M | ..........F....... | ...... | ........... | A..A........ | 0.02 | 3 |
| A.... | .................. | ...............T | ...N.. | ........... | A..A........ | 0.02 | 3 |
| ..... | .................. | .................. | ..AG. | ........... | A.......... | 0.02 | 3 |
| ..... | .................. | .................. | ...D.R | ...GGGDAA..G | A..A........ | 0.02 | 3 |
| DA... | F.....AGA.SL.....R | .........DF......T | ...DG. | ........... | A..A........ | 0.02 | 3 |
| G.... | .................. | .................. | ....GR | ..GAAS.AAFDE | A..A........ | 0.02 | 3 |
| ..... | ......DKA.IK.K.S.G | .................. | ...D.R | ..TG.N.IAF.D | A..A........ | 0.02 | 3 |
| NT... | .................. | .KAS.....NF......T | E..DD. | ........... | ............ | 0.02 | 3 |
| HA... | F.....NKT.I..K.... | ..DGE....DF....... | ...... | E.AGAADA.VDH | A..A........ | 0.02 | 3 |
| ..... | F................. | .QANH....DF....... | ...DDR | ........... | A..A........ | 0.02 | 3 |
| G...T | F.....GGG.NQ.I.S.G | TQ.TG....DF....... | ...DDR | ESAG.DD.A.DQ | A..A........ | 0.02 | 3 |
| G.... | F.....GDT.H..I...G | .QPTG.....F....... | ...N.. | ........... | A..A........ | 0.02 | 3 |
| ..... | .................. | ..........F....... | ....DR | EDGG.S..E.DR | A..A........ | 0.02 | 3 |
| .A... | F.....AEG.LK.M.H.L | ..DGE....DF....... | ...... | ........... | ............ | 0.02 | 3 |
| ..... | F................. | .Q.S.....F....... | E..NG. | ........... | ............ | 0.02 | 3 |
| ..... | F................. | .V........F....... | ...... | ........... | DTRTG..AGK.D | 0.02 | 3 |
| RA... | .................. | T.YNH.....F....... | ...DD. | .D.GG.....GH | A..A........ | 0.02 | 3 |
| DT... | F.....SNA.PK.N.A.S. | ..PN.....NF....... | ...... | .DGGGAD.A.D. | A..A........ | 0.02 | 3 |
| ..... | F................. | .QPTR.....F....... | ....GR | ........... | A..A........ | 0.02 | 3 |
| TA..T | .................. | .PPNG.....F......T | ...DDR | E.GKA....FDG | A..A........ | 0.02 | 3 |
| RA... | .................. | .................. | ...... | ........... | A..A........ | 0.02 | 3 |
| GT... | F.....A...ND.T...K | TQ.TG....DF....... | ...DDR | E.T......... | A..A........ | 0.02 | 3 |
| ..... | .................. | .................. | R..ND. | ........... | A..A........ | 0.02 | 3 |
| NA... | F.....AAT.N..P.P.R | ..PSH...DF..S.... | R..... | E.AG...IAVDR | A..A........ | 0.02 | 3 |
| GA... | F.....G.G.NQ.I.K.N | ..A......DF....... | ...DG. | ........... | A..A........ | 0.02 | 3 |
| ..... | .................. | .KDDR....DF....... | ...DDR | E.GTGA.IE.GD | A..A........ | 0.02 | 3 |
| ..... | F.....AHA.SH.M.S.R | ..DGE...DF....... | ...... | .SGGRS..E.DQ | A..A........ | 0.02 | 3 |
| G.... | F.....AQ...A.L.... | ...........P.... | ...... | ........... | ............ | 0.02 | 3 |
| .A... | .................. | ..........NF....... | R...D. | ..TGAS.A..DH | A..A........ | 0.02 | 3 |
| ..... | .................. | .................. | ...DDR | E.AGTNDI...R | A..A........ | 0.02 | 3 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | F................. | .................. | ....GR | .......... | ............ | 0.02 | 3 |
| ..... | .................. | .................. | ...DDR | ..AAGADTA.DD | A..A........ | 0.02 | 3 |
| AA... | F.....GRG.N......H | T.P.....DF | ...... | .......... | ............ | 0.02 | 3 |
| DT... | F.....S.T.NV.L.D.. | .................. | ...ADR | ..AS...I..G. | A..A........ | 0.02 | 3 |
| ..... | .................. | .................. | R...D. | .SARGA.A.YDD | A..A........ | 0.02 | 3 |
| NA... | F......GG.NA.H.Q.R | .................. | ...... | E.AG...IAVDR | A..A........ | 0.02 | 3 |
| D...T | F......G..NL.T.E.R | .Q.DR.....F | ....D. | .......... | A..A........ | 0.02 | 3 |
| E.... | .................. | .........DF....... | R...D. | ESGTTS....GG | A..A........ | 0.02 | 3 |
| ..... | .................. | .................. | E..ND. | ..AD.A....G. | A..A........ | 0.02 | 3 |
| ..... | .................. | .................. | R...D. | .NGSAS..A.DN | A..A........ | 0.02 | 3 |
| ..... | F.....NG..IQ.M.N.R | .Q.......DF....... | ....AD | .......... | A..A........ | 0.02 | 3 |
| G.... | F......GT.NM.L.Q.G | .Q.S......F | ....D. | .......... | ............ | 0.02 | 3 |
| ..... | .................. | .................. | G..ND. | E.AR.S..EVGE | A..A........ | 0.02 | 3 |
| ..... | F.....AT..ND.K.P.K | .Q.GQ....DF....... | ....G. | .......... | ............ | 0.02 | 3 |
| ..... | .................. | .................. | ...DD. | E.AGGN..E.DD | A..A........ | 0.02 | 3 |
| ..... | .................. | .V........F | ...... | .......... | NNHGP......Q | 0.02 | 3 |
| GA... | F.....ASA.S..T.T.G | .QPG.....DF....... | ...DDR | .......... | A..A........ | 0.02 | 3 |
| ..... | .................. | .V........F | ...... | .......... | TRHTR..AEA.E | 0.02 | 3 |
| ..... | .................. | ..DGE....DF....... | ...ND. | ENAAGGDT..GR | ............ | 0.02 | 3 |
| ..... | .................. | .KYT.....NF......T | ...D.R | ESATGD..E.GQ | A..A........ | 0.02 | 3 |
| RT... | F.....ARG.I..T.A.K | ..DGE....DF....... | ...... | E.AG.S..E.DN | A..A........ | 0.02 | 3 |
| T.... | .................. | ..P.E.....F.......T | R..DD. | .......... | A..A........ | 0.02 | 3 |
| ..... | F................. | .V | ...AG. | .......... | A..A........ | 0.02 | 3 |
| ..... | F.....DGA.R..P.A.K | ..YN......F.......T | R..DD. | .......... | A..A........ | 0.02 | 3 |
| ..... | F................. | .V........F | ...... | .......... | AHSGG..FET.A | 0.02 | 3 |
| ..... | ......STA..Q.H.Q.L | .........NF | E..NGR | .......... | A..A........ | 0.02 | 3 |
| ..... | F................. | .V........F | ...... | .......... | GNHAA..FDM.. | 0.02 | 3 |
| ..... | .................. | .........DF......T | R..AGR | EDAGT...AFD. | A..A........ | 0.02 | 3 |
| D...T | F......GT.NM.L.Q.G | .Q.S......F | ....D. | .......... | A..A........ | 0.02 | 3 |
| G...T | F......S..PM.T.S.K | ..DGE....DF | ...... | .......... | A..A........ | 0.02 | 3 |
| ..... | .................. | T.Y.G....NF | ....GR | E.T..S..A..R | A..A........ | 0.02 | 3 |
| ..... | F................. | .V........F | ...... | .......... | A.QAP..ATE.Q | 0.02 | 3 |
| ..... | .................. | .................. | G..K.. | EN.G.A....Q | A..A........ | 0.02 | 3 |
| GT... | F.....AEG.LK.M.H.L | ..ADH....DF | ...... | .......... | A..A........ | 0.01 | 2 |
| DA... | F.....DAG.PM.I.N.R | ................T | R..D.. | .......... | A..A........ | 0.01 | 2 |
| GA... | F.....G.G.NQ.I.K.N | ..A......DF....... | ....D. | E.TGAN.AE.GE | A..A........ | 0.01 | 2 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | F.....AEG.LK.M.H.L | ..DGE....DF....... | ...... | ............ | ATRA...VDN.. | 0.01 | 2 |
| HA... | ................. | TKAT.....NF......T | ...DDR | .D.AAS..EFGQ | A..A........ | 0.01 | 2 |
| DT... | R.....ASA.S..T.T.G | .QPG.....DF....... | ...DDR | ............ | ............ | 0.01 | 2 |
| ..... | ................. | .V........F....... | ...... | ............ | NPRDP..NNG.. | 0.01 | 2 |
| ..... | ................. | TQDS.....NF....... | ...A.. | E.AGTNDI.... | A..A........ | 0.01 | 2 |
| RA... | F.....G.G.HA.T.G.R | ..YN......F......T | ....D. | ............ | A..A........ | 0.01 | 2 |
| ..... | F.....SEA.IH...Q.L | .Q.DR.....F....... | ....D. | .NAGA.D...GS | A..A........ | 0.01 | 2 |
| ..... | F.....GG..NE.K.G.V | .QPN......F..P.... | ...... | ..AG.N..EV.S | A..A........ | 0.01 | 2 |
| DA..T | F......EG.S..T.K.K | ..A......DF....... | ...DG. | ..AGE....VG. | A..A........ | 0.01 | 2 |
| EA... | ................. | .QAS.....NF......T | ....GR | E.AGRDD..V.E | A..A........ | 0.01 | 2 |
| ..... | F................ | .V........F....... | ...... | ............ | NSRAT..S.G.H | 0.01 | 2 |
| ..... | F................ | .V........F....... | ....D. | ............ | ............ | 0.01 | 2 |
| A.... | F.....DK...M.K.P.M | .........NF....... | ...D.. | ED.A.G.T..DN | A..A........ | 0.01 | 2 |
| ..... | ................. | ................. | E..T.. | ............ | ............ | 0.01 | 2 |
| ..... | F.....STG.NP.M.E.R | ...TE.....F......T | ...... | ............ | A..A........ | 0.01 | 2 |
| ..... | F................ | .V........F....... | ...... | ............ | STKSG..YSA.Q | 0.01 | 2 |
| ..... | ................. | ................. | ...ADR | ............ | A..A........ | 0.01 | 2 |
| G.... | ................. | .PPNG.....F......T | ...... | ..ADGA..AYDR | A..A........ | 0.01 | 2 |
| ..... | ................. | ................. | ...DD. | ESAGRS...VDR | A..A........ | 0.01 | 2 |
| ..... | F.....GK..LA.K.N.G | ................. | ...... | ..AGT.D.EYGQ | A..A........ | 0.01 | 2 |
| GA... | ................. | ................. | ....D. | .D..TD....GD | A..A........ | 0.01 | 2 |
| ..... | ................. | ................. | ....D. | .NATG....VGS | A..A........ | 0.01 | 2 |
| GT... | F......S..PM.T.S.K | ..DGE....DF....... | ...... | E.TGGS.I.YDR | A..A........ | 0.01 | 2 |
| ..... | ................. | .KPSE....DF......T | ...D.. | ............ | A..A........ | 0.01 | 2 |
| ..... | ................. | TQADR....NF......T | ....D. | EDAK.N...Y.N | A..A........ | 0.01 | 2 |
| ..... | ................. | .........DF......T | R..TDR | .DGGR....VDG | ............ | 0.01 | 2 |
| TA... | F.....SRA.SK.N.A.H | .QDT.....DF....... | ...DDR | ...G.S..E.DR | A..A........ | 0.01 | 2 |
| GT... | F.....DGT.IA.L...R | ................. | R..N.. | E.A.GS....GG | A..A........ | 0.01 | 2 |
| N.... | F.....GS..NM.N.T.R | ................. | ...D.. | E.AGAND.AV.H | A..A........ | 0.01 | 2 |
| ..... | F.....G.G.NQ.I.K.N | ..A......DF....... | ...DG. | ............ | A..A........ | 0.01 | 2 |
| AA... | ................. | .........NF......T | ...DDR | E..G.SDAA.GD | A..A........ | 0.01 | 2 |
| DT... | ................. | .QPN......F......T | ....D. | ............ | A..A........ | 0.01 | 2 |
| ..... | ................. | ................. | E..KD. | .SAAAA.I.F.H | A..A........ | 0.01 | 2 |
| ..... | ................. | ..DGE....DF....... | R...D. | ............ | A........... | 0.01 | 2 |
| DT... | F.....AEG.LK.M.H.L | ..DGE....DF......T | R..DD. | ............ | A..A........ | 0.01 | 2 |
| NA... | F.....SRG..L.P.G.G | .QPSE....DF....... | ...DD. | ............ | A..A........ | 0.01 | 2 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| NA... | .................. | ..DGE....DF....... | ...... | ........... | A..A........ | 0.01 | 2 |
| ..... | .................. | .................. | R...D. | ....AG..AV.D | A..A........ | 0.01 | 2 |
| ..... | F.....SGT.S..P.A.K | ..HG.....NF....... | ...... | E.......... | A..A........ | 0.01 | 2 |
| ..... | F................. | .V........F....... | ...... | ........... | SAKDS..DNG.. | 0.01 | 2 |
| TA... | F.....DKA.IK.K.S.G | .................. | ...D.R | ..TG.N.IAF.D | A..A........ | 0.01 | 2 |
| TA... | .................. | .................. | ....D. | E.......... | A..A........ | 0.01 | 2 |
| H.... | F.....ASA.S..T.T.G | ..HG.....NF......T | ...A.. | ........... | A..A........ | 0.01 | 2 |
| ..... | F......QG.NQ...A.R | .KYT.....NF......T | ...D.. | ........... | A..A........ | 0.01 | 2 |
| A.... | .................. | TQ.TQ....DF....... | ...DDR | E..RRD.AA..H | A..A........ | 0.01 | 2 |
| ..... | ................K | ........F........ | ...... | ........... | ARSNR..FDV.H | 0.01 | 2 |
| ..... | .................. | ..AGR....DF......T | ....D. | ........... | A..A........ | 0.01 | 2 |
| D.... | F.....ATT.HP.L.T.L | TQADR.D..NF......T | G..TD. | .SAKAA.AA.DE | A..A........ | 0.01 | 2 |
| G.... | F................. | .V........F....... | ...... | ........... | NPRGA..S.G.E | 0.01 | 2 |
| ..... | F................. | .V........F....... | ...... | ........... | G.RTH...S..H | 0.01 | 2 |
| ..... | .................. | .........DF......T | R..D.. | E.TA.S..EY.. | A..A........ | 0.01 | 2 |
| EA... | F................. | TQDGE....DF....... | ....D. | ED.GAG..AV.G | A..A........ | 0.01 | 2 |
| .A... | F.....SG..IK.K.D.R | ..HG.....NF......T | E..N.. | ........... | A..A........ | 0.01 | 2 |
| E.... | F.....ASA.S..T.T.G. | .QD.E.....F..P.... | ...D.. | ........... | A..A........ | 0.01 | 2 |
| TA..T | F......EG.LQ.M.A.K | .KDSR....DF....... | ...DDR | ........... | A..A........ | 0.01 | 2 |
| ..... | .................. | .........NF....... | R...D. | .DGGGS.....G | A..A........ | 0.01 | 2 |
| ET..T | F.....AKG.NM.L...K | ..YN......F......T | ...D.R | ES.G..D..VGG | A..A........ | 0.01 | 2 |
| D...T | .................. | .........F......T | R..N.. | ........... | A..A........ | 0.01 | 2 |
| NA... | F.....SG..IK.K.D.R | ..DGE....DF....... | ...... | EDANRN..E..R | A..A........ | 0.01 | 2 |
| ..... | .................. | .................. | ...DDR | EDAA...AAVDQ | A..A........ | 0.01 | 2 |
| ..... | .................. | .QAS.....NF......T | ....GR | .NGGTG..A.DR | A..A........ | 0.01 | 2 |
| NT..T | .................. | .................. | G..DG. | ........... | ........... | 0.01 | 2 |
| GT... | F.....SR..NE.M...S | ..DGE....DF....... | ...NDR | ........... | A..A........ | 0.01 | 2 |
| ..... | F.....GKT.SL...G.R | ..DGE....DF....... | ...DG. | ..ATG..I.F.R | A..A........ | 0.01 | 2 |
| ..... | F.....SAG..L.H...K | .........NF....... | E..NG. | ........... | A..A........ | 0.01 | 2 |
| ....T | F......TT.HN.L.G.R | .Q.DH....NF....... | ...DD. | ........... | A..A........ | 0.01 | 2 |
| E.... | .................. | .QANH.....F......T | R..D.. | .SAKAA.AA.DE | ........... | 0.01 | 2 |
| .T... | .................. | .V........F....... | R..ND. | ..AG...T.V.N | A..A........ | 0.01 | 2 |
| ..... | .................. | .Q.......DF....... | ...DDR | ES.SED....GG | A..A........ | 0.01 | 2 |
| TT... | F.....NGT.IL.T.A.K | TKA......NF......T | ...... | ........... | A..A........ | 0.01 | 2 |
| ..... | .................. | .................. | ....G. | ..TTGAD.EVGG | A..A........ | 0.01 | 2 |
| AT... | F.....ATG.NV.T.G.R | ..HDG....F........ | ...... | ........... | A..A........ | 0.01 | 2 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | ................. | ..HG.....NF......T | ...A.. | .SA....AEVDD | A..A........ | 0.01 | 2 |
| SA... | F.....S.T..I.K.N.M | ................. | E..KD. | ............ | ............ | 0.01 | 2 |
| ..... | ................. | ..P.E.....F......T | R..DD. | ............ | A..A........ | 0.01 | 2 |
| .T... | ................. | ................. | E..DDR | E.AAAD.I..GQ | A..A........ | 0.01 | 2 |
| NA... | F.....GQT.SP.T.D.K | .V........F....... | E..AGR | E...GG.DIAY.E | A..A........ | 0.01 | 2 |
| ..... | ................. | .Q.DR.....F....... | ....D. | ............ | A..A........ | 0.01 | 2 |
| GT... | F................. | ................. | R..D.. | ..ASAAD.E..D | A..A........ | 0.01 | 2 |
| G.... | F.....AT..ND.K.P.K | .Q.GQ....DF....... | ....G. | ............ | A..A........ | 0.01 | 2 |
| ..... | .......GT.NM.L.Q.G | .Q.S......F....... | ....D. | ............ | A..A........ | 0.01 | 2 |
| ..... | ................. | ................. | G..K.. | E.AGG.DI..GH | A..A........ | 0.01 | 2 |
| GT... | F.....AEG.LK.M.H.L | ................. | G..DG. | ............ | ............ | 0.01 | 2 |
| ..... | ................. | .V........F....... | ...... | ............ | NARSG..SR..H | 0.01 | 2 |
| A.... | ................. | TQ.TG....DF....... | ...... | ..ARAA.I..GQ | ............ | 0.01 | 2 |
| ..... | F................. | .V........F....... | ...... | ............ | AESSG..AEI.E | 0.01 | 2 |
| G.... | F.....ATT.NV.T.K.S | .........NF....... | R...D. | ............ | A..A........ | 0.01 | 2 |
| HA... | ................. | ................. | ...DD. | ..ASTDDA.VGE | A..A........ | 0.01 | 2 |
| RA... | ................. | .KYT......F....... | ...... | E.TAAA.A..DG | A..A........ | 0.01 | 2 |
| SA... | ................. | ................. | E..KG. | ............ | ............ | 0.01 | 2 |
| ..... | F................. | .V........F....... | ...... | ............ | SRQTG..YTN.P | 0.01 | 2 |
| GT... | F.....GG..NK.M.... | .QPSE....DF....... | R..D.. | ............ | A..A........ | 0.01 | 2 |
| TA... | F.....ASA.S..T.T.G | .QD.E.....F..P.... | ...D.. | ............ | ............ | 0.01 | 2 |
| ..... | ................. | ................. | ...DD. | .N.GA.D.A.GG | A..A........ | 0.01 | 2 |
| ..... | ................. | ................. | ...N.. | E.AG...IAVDR | A..A........ | 0.01 | 2 |
| RA... | ................. | ..DNH....NF....... | ...D.. | .NGGTG..A.DR | A..A........ | 0.01 | 2 |
| EA... | F.....SD..HP.L.Q.K | .Q.DH....NF....... | ...DD. | ............ | A..A........ | 0.01 | 2 |
| E.... | ................. | .KDDG....NF......T | ...DDR | .SGATG.AA.GE | A..A........ | 0.01 | 2 |
| SA... | ................. | TQYDR....NF....... | R...D. | .SAKAA.AA.DE | A..A........ | 0.01 | 2 |
| ..... | ................. | ..........F....... | ...D.. | ............ | A..A........ | 0.01 | 2 |
| DT... | ......AST.IN.L.T.. | ..DGE....DF....... | ...G.. | ............ | ............ | 0.01 | 2 |
| SA... | ................K | ................. | G..ND. | E.AG...IAVDR | A..A........ | 0.01 | 2 |
| ..... | ................. | ................. | ...... | ..TGAS..EV.N | A..A........ | 0.01 | 2 |
| DA... | F.......G.SE.N...R | .PPNG.....F....... | ...... | ENAATA.AA..E | A..A........ | 0.01 | 2 |
| TA... | F.....SRA.SK.N.A.H | ................. | ....GR | ..AG.N.AA.GQ | A..A........ | 0.01 | 2 |
| N.... | ................. | .QANH.....F......T | ...ADR | E.ANGG.A...D | A..A........ | 0.01 | 2 |
| R.... | ................. | ................. | R...D. | ............ | A..A........ | 0.01 | 2 |
| SA... | ................. | ................. | ....GR | ..AG.N.AA.GQ | A..A........ | 0.01 | 2 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ..... | ................. | ..DGE....DF....... | ...... | E.ASGSDIE.DR | A..A........ | 0.01 | 2 |
| E.... | F.....DGA.R..P.A.K | .QPTR....DF....... | E..NG. | ............ | A..A........ | 0.01 | 2 |
| .A... | F................ | .V........F....... | ...... | ............ | GQ.TP..IRT.A | 0.01 | 2 |
| ..... | ................. | ................. | ....GR | ..AG.N.AA.GQ | ............ | 0.01 | 2 |
| AA... | ................. | .Q.DR.....F....... | ....D. | ..AKG...AV.. | A..A........ | 0.01 | 2 |
| AA... | ................. | .QHNQ.....F......T | ...N.. | ..AST..AA..D | A..A........ | 0.01 | 2 |
| SA..T | F.....GGG.HK.T...G | .K.T......F....... | ...... | ............ | A..A........ | 0.01 | 2 |
| ..... | F................ | .V........F....... | ...... | ............ | GPRST..S.E.P | 0.01 | 2 |
| ..... | ................. | ................. | G..K.. | ............ | A..A........ | 0.01 | 2 |
| E.... | F.....ASA.S..T.T.G | .QPG.....DF....... | ...... | ..TNESD..... | A..A........ | 0.01 | 2 |
| T.... | F.....DAG.SA...H.R | ..HG.....NF......T | ...A.. | ............ | A..A........ | 0.01 | 2 |
| G.... | F................ | ................. | R..TG. | ............ | A..A........ | 0.01 | 2 |
| .A... | F.....ASA.S..T.T.G | .Q.DH....NF....... | ...DD. | ............ | A..A........ | 0.01 | 2 |
| ..... | ................. | .PPNG.....F......T | R...D. | EDAGT...AFD. | A..A........ | 0.01 | 2 |
| ..... | ................. | ................. | ...TG. | ............ | A..A........ | 0.01 | 2 |
| ..... | ................. | ................. | ...... | ..TNESD..... | ............ | 0.01 | 2 |
| ..... | ................. | .........NF....... | R...D. | EDGGGS..E.GR | A..A........ | 0.01 | 2 |
| G.... | ................. | ................. | ...DDR | ............ | ............ | 0.01 | 2 |
| ..... | F.....DQ..R..P.S.R | .KD.E.....F..P...T | R...D. | ............ | A..A........ | 0.01 | 2 |
| ..... | ................. | ..DGE....DF....... | ...... | .DGTGGD.A..R | A..A........ | 0.01 | 2 |
| ..... | ................. | .........DF....... | G..NDR | .D.SAG...Y.G | A..A........ | 0.01 | 2 |
| E.... | F.....DRG.S..T.A.S | .V........F....... | ...... | ............ | ..RAG..DTE.Q | 0.01 | 2 |
| DT... | ......AST.IN.L.T.. | ..EGE....DF....... | ...... | ............ | ............ | 0.01 | 2 |
| ..... | ................. | ................. | ...... | ............ | GP.NA..YRE.Q | 0.01 | 2 |
| ..... | ................. | ................. | E..AD. | ............ | ............ | 0.01 | 2 |
| E.... | ................. | ..P.G....KF....... | ...D.R | ENGT.G.I... | A..A........ | 0.01 | 2 |
| E.... | ......SK..PA.K.A.G | ................. | ...A.. | ............ | A..A........ | 0.01 | 2 |
| GT... | F.....NTG.RN.T.T.L | .QP.G.....F....... | ...... | ............ | A..A........ | 0.01 | 2 |
| ..... | F......GG.NV...K.. | .PPNG.....F......T | ...DDR | ............ | A..A........ | 0.01 | 2 |
| DA..T | ................. | .........NF....... | R...D. | E..G.A..E.GR | A..A........ | 0.01 | 2 |
| ..... | F.....NN..N..M...G | ..PDG....DF....... | ...DDR | ............ | GQKDR..ST..H | 0.01 | 2 |
| ..... | F................ | .V........F....... | ...... | ............ | ATKAP..SDG.T | 0.01 | 2 |
| ..... | ................. | ................. | ...DDR | .DAKGN..EVGQ | AA.A.......D | 0.01 | 2 |
| ..... | ................. | ................. | E..KD. | ..AS...I..G. | A..A........ | 0.01 | 2 |
| .T... | F................ | .V........F....... | ...... | R.......... | SERAG..YQ..Q | 0.01 | 2 |
| TA..T | F................ | .V........F....... | ...... | ............ | SRQAH..SDM.E | 0.01 | 2 |

TABLE 7-continued

AAV capsid proteins having increased specificity for and/or transduction of CD44+ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ..... | ................ | .................. | G..DD. | E.AG...TAVGN | A..A........ | 0.01 | 2 |
| ..... | ................ | .................. | E..AD. | ENG.AN.AE.DE | A..A........ | 0.01 | 2 |
| ..... | ................ | .................. | R..N.. | ..AKAND...GS | A..A........ | 0.01 | 2 |
| E.... | F............... | .................. | ...DD. | ..ASTDDA.VGE | A..A........ | 0.01 | 2 |
| ..... | ................ | N................. | R..A.. | ED.NGN.IA.D. | A..A........ | 0.01 | 2 |
| RT... | ................ | .................. | ...... | ............ | ............ | 0.01 | 2 |
| NT... | F.....AGA.NK.L...K | .................T | G..D.R | ............ | A..A........ | 0.01 | 2 |
| RA... | F.....ASA.S..T.T.G | .QPG.....DF....... | ...DDR | ............ | ............ | 0.01 | 2 |
| NA... | ................ | .................. | E..NG. | ............ | A........... | 0.01 | 2 |
| ..... | ......ASA.S..T.T.G | .QPG.....DF....... | ...DDR | ............ | ............ | 0.01 | 2 |
| ET... | F.....SGT.SQ.K.E.. | ..DGE....DF....... | ...... | EDTGAD....DS | A..A........ | 0.01 | 2 |
| ..... | ................ | .........NF....... | ...... | ..GGTD....DR | A..A........ | 0.01 | 2 |
| ..... | ................ | .QPN......F......T | ...DD. | ..TGAS..EV.N | A..A........ | 0.01 | 2 |
| ..... | ................ | TQ.TG....DF....... | ...... | ..ARAA.I..GQ | A..A........ | 0.01 | 2 |
| NA..T | F.....STA..Q.H.Q.L | TQPTE....DF....... | ....D. | ..AAE.D....N | A..A........ | 0.01 | 2 |
| ..... | F.....GKG.RK.L.N.E | ...GG.....F......T | ...D.. | ............ | A..A........ | 0.01 | 2 |
| ..... | ................ | .................. | R..DD. | E.ARAN.IEVDQ | A..A........ | 0.01 | 2 |
| ..... | F.....NQG....P.K.I | TK.NE....DF......T | ...... | ..AGAN..A.GD | A..A........ | 0.01 | 2 |
| A.... | F.....AGG.IN.L.T.. | .QD.E.....F..P.... | R..DDR | ............ | A..A........ | 0.01 | 2 |
| ..... | F............... | .................. | R..DD. | ............ | ..D......... | 0.01 | 2 |
| ..... | ................ | .................. | ...... | ED.A.A....GQ | A..A........ | 0.01 | 2 |
| RA... | ................ | TQP.R....NF......T | ...D.. | ............ | A..A........ | 0.01 | 2 |
| NA..T | F......ET.SP.I.G.. | .QAS.....NF......T | ....GR | E.GATG...VD. | A..A........ | 0.01 | 2 |
| A.... | ................ | .QPN......F......T | ...N.. | .D.GRAD.AF.S | A..A........ | 0.01 | 2 |
| ..... | ................ | ..HG.....NF......T | ...A.. | EDAG.AD.E.G. | A..A........ | 0.01 | 2 |
| E.... | ................ | T.PGG....NF....... | ...DD. | ..GAGS..AV.E | A..A........ | 0.01 | 2 |
| ..... | ................ | .................. | R..D.R | EDGARA..A.GE | A..A........ | 0.01 | 2 |
| GT... | F.....STA.HA.M.S.V | ..DGE....DF....... | ...... | .SAKAA.AA.DE | A..A........ | 0.01 | 2 |
| E.... | F.....NTT.SK.M.K.R | .QD.E.....F..P... | ...... | ............ | A..A........ | 0.01 | 2 |
| ..... | ................ | .................. | ...DDR | ENAAAN.A.Y.S | A..A........ | 0.01 | 2 |
| ..... | F............... | ..DGE....DF....... | ...D.. | ESGT.G.AEVDD | A..A........ | 0.01 | 2 |
| ..... | ................ | ..PDH....DF....... | ...NGR | ED.T.D..A.DR | A..A........ | 0.01 | 2 |
| TT..T | F.....SA..RA.....R | .................. | G..ND. | ............ | ............ | 0.01 | 2 |
| ..... | ................ | ..........DF...... | ...DD. | .D..R.D.E... | A..A........ | 0.01 | 2 |
| G.... | F.....GE..LQ.N.T.R | ..PTG....DF....... | ...DDR | ESGTAND...DR | A..A........ | 0.01 | 2 |
| G.... | ................ | ..DGE....DF....... | ...... | .SGARD.A..DG | A..A........ | 0.01 | 2 |

TABLE 7-continued

AAV capsid proteins having increased specificity for and/or transduction of CD44$^+$ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| TA..T | F.....NGG.IM.L.E.R | T.P......DF....... | ....D. | ........... | ........... | 0.01 | 2 |
| TA... | ................. | .................. | ...DDR | ..AGES.A.Y.Q | A..A........ | 0.01 | 2 |
| ..... | ................. | .............F | ...DDR | EN.DGNDT..DG | A..A........ | 0.01 | 2 |
| A.... | ................. | ................T | ...DDR | EDGDGA..A.DR | A..A........ | 0.01 | 2 |
| ..... | ................. | .................. | ....GR | .STAAG...VDG | A..A........ | 0.01 | 2 |
| G.... | ................. | .................. | ...D.R | ..TGAS.A..DH | A..A........ | 0.01 | 2 |
| E.... | ................K | ..YN......F......T | ...D.R | .NGR.G..A..E | A..A........ | 0.01 | 2 |
| GT... | F................. | .KAS.....NF......T | ....GR | ........... | ........... | 0.01 | 2 |
| NA... | ................. | .................. | ...DDR | ..AGES.A.Y.Q | A..A........ | 0.01 | 2 |
| .A... | ................. | ..........NF....... | ...DDR | ...TG..T..GQ | A..A.......T | 0.01 | 2 |
| ..... | ................. | TKPAH.....F | ...... | ........... | T.STR..DEK.. | 0.01 | 2 |
| ..... | ................. | .................. | ....D. | .DAAGN..A..E | A..A........ | 0.01 | 2 |
| AA... | F.....A.G.NQ.T.G.R | .................. | ...... | .S.GTGDIAVDQ | A..A........ | 0.01 | 2 |
| ST... | ................. | TQDS.....NF....... | ...A.. | E.AGNTDI.... | A..A........ | 0.01 | 2 |
| ..... | .....AHA.SH.M.S.R | ..DGE....DF....... | ...D.. | .SGGRS..E.DQ | A..A........ | 0.01 | 2 |
| ..... | ................. | ................A. | ...D.. | E.AGAND.AV.H | A..A........ | 0.01 | 2 |
| ..... | ................. | TKAT.....NF......T | G..TG. | ........... | A..A........ | 0.01 | 2 |
| GT... | ................. | .QANH....DF....... | ...DDR | ........... | A..A........ | 0.01 | 2 |
| G.... | F.....GN..HM.P.... | .QPN......F......T | R...D. | ........... | A..A........ | 0.01 | 2 |
| ..... | ................. | .Q.DR.....F....... | ....D. | E.TD.A....DG | A..A........ | 0.01 | 2 |
| ..... | ................. | .................. | R..DG. | E.TT.A...VGD | A..A........ | 0.01 | 2 |
| DT... | F.....GG..RV.I.G.R | .V........F....... | R..... | ESGG.G..E... | A..A........ | 0.01 | 2 |
| ....T | ................. | .................. | ....D. | ........... | A..A........ | 0.01 | 2 |
| ..... | ................. | .................. | ...D.R | ...NRSD.A..S | A..A........ | 0.01 | 2 |
| RA..T | F......GD.HP.K...V | ..DGE....DF....... | ...... | ........... | A..A........ | 0.01 | 2 |
| ..... | ................. | .................. | ...... | ........... | KPHSP..VSE.T | 0.01 | 2 |
| TA... | F.....GN..NA.T.... | TQ.TG............. | ...... | E..K.GDA...S | A..A........ | 0.01 | 2 |
| ..... | ................. | ..HQ.....NF......T | ...A.. | E.TKGS.AEF.G | A..A........ | 0.01 | 2 |
| ..... | ................. | ..P......DF....... | ....G. | ........... | ........... | 0.01 | 2 |
| ..... | ................. | .................. | R..N.. | ...G.N.A.... | A..A........ | 0.01 | 2 |
| DT... | F................. | .Q.S......F....... | E..NG. | ........... | ........... | 0.01 | 2 |
| RA... | F.....GRT.S..L.G.R | .QANH.....F......T | E..T.. | ........... | A..A........ | 0.01 | 2 |
| E.... | ................. | ..DGE....DF....... | R...DR | ..T.GNDI..GN | A..A........ | 0.01 | 2 |
| ..... | F.....AGG.IV.L.G.R | ..DGE....DF....... | ...... | E.GA.N..A..H | A..A........ | 0.01 | 2 |
| ..... | ................. | TQ.TG...DF....... | ...DDR | ENATASD...GS | A..A........ | 0.01 | 2 |
| G.... | F......S..PM.T.S.K | T.P......DF....... | ...D.. | ........... | A..A........ | 0.01 | 2 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| G.... | ................. | .................. | G..TDR | E.AGGN..E.DD | A..A........ | 0.01 | 2 |
| ..... | F................. | .V........F....... | ...... | ............ | .R.DG..AT..A | 0.01 | 2 |
| TA... | ................. | .................. | ....GR | ..AG.N.AA.GQ | A..A........ | 0.01 | 2 |
| TA... | ................. | ..HG.....NF......T | E..DD. | ............ | A..A........ | 0.01 | 2 |
| ..... | ................. | .................. | ...DD. | .SGR.N.T..GD | A..A........ | 0.01 | 2 |
| ..... | ................. | .KPQG.....F......T | ...N.. | ENAGRAD.AFD. | A..A........ | 0.01 | 2 |
| RA... | F.....SGA..N...G.R | .Q.......DF....... | ...AD. | .NAAEND...GE | A..A........ | 0.01 | 2 |
| ..... | ................. | .................. | ...D.. | E.TS.D..AFDQ | A..A........ | 0.01 | 2 |
| A...T | ................. | .QANH.....F......T | R..A.. | E..A.ADA..GD | A..A........ | 0.01 | 2 |
| EA... | F................. | .................. | ...DDR | E.AAGADT...S | ............ | 0.01 | 2 |
| ..... | F.....GRG.NN.T.G.. | .................. | ...... | ENAG.ND.E.DH | A..A........ | 0.01 | 2 |
| ..... | ................. | .................. | ....GR | E.ARGGDA.F.Q | A..A........ | 0.01 | 2 |
| GT... | ......ASA.S..T.T.G | .QPG.....DF....... | ...DDR | ............ | ............ | 0.01 | 2 |
| A...T | F......K.....L.G.L | .Q.S......F....... | E..N.. | ............ | A..A........ | 0.01 | 2 |
| R.... | F.....NG..SN.M...K | ...G.....DF....... | G..ADR | .NAA.A....GD | A..A........ | 0.01 | 2 |
| ..... | ................. | .V........F....... | ...... | ..AGRADIEVGS | A..A........ | 0.01 | 2 |
| GT... | F.....DTG.PA.L.T.K | ..DGE....DF....... | ...... | E.AGAND.AY.N | A..A........ | 0.01 | 2 |
| ..... | ..............R.... | ..DGE....DF....... | ...... | ............ | ............ | 0.01 | 2 |
| ..... | ................. | ................T | G..DD. | ESAA.D..E.GD | A..A........ | 0.01 | 2 |
| ..... | F.....ARA.L..L.Q.G | ...NG.....F....... | R...GR | ............ | A..A........ | 0.01 | 2 |
| ..... | ................. | .................. | E..N.. | E.AGGN...FGE | A..A........ | 0.01 | 2 |
| AA... | F.....ASA.S..T.T.G | .QPG.....DF....... | ...DDR | ............ | ............ | 0.01 | 2 |
| RA... | ................. | .................. | ...DDR | .STAES.IH.DG | A..A........ | 0.01 | 2 |
| ..... | ................. | .Q.GQ....DF....... | ....G. | E.AGAD..AVGE | A..A........ | 0.01 | 2 |
| ..... | ................. | .................. | ....D. | EDAGRND.AFDH | A..A........ | 0.01 | 2 |
| ..... | ................. | .................. | ...DD. | ............ | GPHAG..FDT.A | 0.01 | 2 |
| G.... | F.....DSG.NM.H.A.R | .Q.DH....NF....... | ...... | ............ | A..A........ | 0.01 | 2 |
| ..... | ................. | .................. | G..ND. | E..RADD.E..Q | A..A........ | 0.01 | 2 |
| ET..T | ................. | .................. | R...D. | ...AAS.A.VGQ | A..A........ | 0.01 | 2 |
| TT... | F.....DNG..D.M.G.R | .KDSR....DF....... | ...DG. | ............ | A..A........ | 0.01 | 2 |
| AT... | F.....DA..IA.L.K.R | .QPN......F....... | ...DG. | ............ | A..A........ | 0.01 | 2 |
| ..... | ..............T.. | ..HG.....NF......T | ...A.. | ..AG.SD.EVG. | A..A........ | 0.01 | 2 |
| DT... | F................. | .........F......T | R..TDR | ............ | ............ | 0.01 | 2 |
| SA... | ................. | .K.TG....DF....... | G..ND. | ............ | A..A........ | 0.01 | 2 |
| R.... | ................. | T.D.R...NF....... | ...... | ..ANAG.A.V.Q | A..A........ | 0.01 | 2 |
| ..... | F................. | .................. | R..N.. | ..AKAND...GS | A..A........ | 0.01 | 2 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| GA... | F......S..SE.T...R | TQYT.....NF......T | R..AD. | .SAGAN..E..S | A..A........ | 0.01 | 2 |
| ..... | .................. | .................. | ...D.R | ..TGAS.A..DH | A..A........ | 0.01 | 2 |
| GA... | F.....SG..IK.K.D.R | ..ADH....DF....... | E..AD. | .SADAG..A..S | A..A........ | 0.01 | 2 |
| E.... | F.....S.T.NV.L.D.. | .QPSQ....NF....... | ...... | E.AS.A.TAV.H | A..A........ | 0.01 | 2 |
| E.... | .................. | .................. | E..NG. | ............ | ............ | 0.01 | 2 |
| D...T | .................. | .V........F....... | ....GR | ..AG.N.AA.GQ | A..A........ | 0.01 | 2 |
| ..... | F................. | .................. | ...DDR | E.A.AD.AAF.. | A..A........ | 0.01 | 2 |
| ..... | .................. | .V........F....... | ...... | ............ | DPKTA..VRG.. | 0.01 | 2 |
| DT... | .................. | .................. | R...D. | ............ | A..A........ | 0.01 | 2 |
| A.... | F.....GHA.SK.T.E.K | .Q.S......F....... | E..N.. | EDAKGND.A..N | A..A........ | 0.01 | 2 |
| G.... | .................. | .PPNG.....F......T | ...DDR | EDGNGSDT..DS | A..A........ | 0.01 | 2 |
| TA... | F.....DEA.RQ.T.N.L | .........NF....... | R...D. | ..ASE...E.D. | A..A........ | 0.01 | 2 |
| ..... | F................. | .V....D...F....... | ...... | ............ | AARDG...TV.H | 0.01 | 2 |
| ..... | .................. | .........DF......T | R...G. | .NASEN...FDR | ............ | 0.01 | 2 |
| ..... | .................. | ..HGH....NF......T | ...D.. | ............ | GPQGR..SR..A | 0.01 | 2 |
| ..... | F.....SG..IK.K.D.R | .Q.G.....NF......T | ...NGR | ............ | A..A........ | 0.01 | 2 |
| ..... | F.....ATT.NV.T.K.S | .PHD.....DF......T | ...DG. | ............ | ............ | 0.01 | 2 |
| SA..T | F.....NTG.RN.T.T.L | ..DDG....NF....... | ...DD. | ............ | A..A........ | 0.01 | 2 |
| ..... | F.....GRG.SP.K...G | .QPG.....NF....... | ...DDR | ............ | DRRSA..YTT.Q | 0.01 | 2 |
| ..... | .................. | .................. | ...DDR | EDAGGS.AEYD. | A..A........ | 0.01 | 2 |
| ..... | F................. | .V........F....... | ...... | ............ | TAKDA..F.R.E | 0.01 | 2 |
| GT... | F......GT.NM.L.Q.G | .Q.S......F....... | ....D. | ............ | ............ | 0.01 | 2 |
| ..... | F................. | .................. | ...D.R | E.AG...IAYGN | A..A........ | 0.01 | 2 |
| ..... | F................. | .V........FL...... | ...... | ............ | GARA...ISG.Q | 0.01 | 2 |
| A.... | F......G..NQ.N.A.G | TKAT.....DF......T | ...DDR | ............ | A..A........ | 0.01 | 2 |
| ..... | .........K.L...G | .................. | ...DDR | ............ | A..A........ | 0.01 | 2 |
| RA... | .................. | .QYGQ....DF....... | ...... | ............ | G.QSP..DGA.T | 0.01 | 2 |
| TT... | F.....NGT.IL.T.A.K | TKPS.....DF......T | ...DG. | E.AG.A..EF.R | A..A........ | 0.01 | 2 |
| ..... | .................. | .........DF....... | ...DDR | .SGATG.AA.GE | A..A........ | 0.01 | 2 |
| ..... | F................. | .V........F....... | ...... | ............ | TQRNT..V.E.H | 0.01 | 2 |
| ..... | F.....STA..Q.H.Q.L | T.P......DF....... | R...D. | ............ | ............ | 0.01 | 2 |
| ..... | F................. | .V........F....... | ...... | ............ | GPQGR..SR..A | 0.01 | 2 |
| ..... | .................. | ......D........... | E..TD. | ............ | A..A........ | 0.01 | 2 |
| G.... | F.....G.T.IN.T...H | .QPG.....NF....... | ...DDR | ............ | A..A........ | 0.01 | 2 |
| ..... | F................. | .V........F....... | ...... | ............ | SAKTA..FE... | 0.01 | 2 |
| A.... | .................. | .KYT.....NF......T | ....GR | ..G..AD.A.DE | A..A........ | 0.01 | 2 |

TABLE 7-continued

AAV capsid proteins having increased specificity for and/or transduction of
CD44$^+$ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ..... | F................. | .V........F....... | ...... | ............ | GERAS..ID..Q | 0.01 | 2 |
| .A... | F.....DGA.R..P.A.K | .QPNQ....NF......T | G..N.. | ............ | A...A........ | 0.01 | 2 |
| G...T | ................. | .Q.S......F....... | ....D. | ............ | ............ | 0.01 | 2 |
| ..... | ................. | ................. | G..KD. | ...NRAD.E..Q | A...A........ | 0.01 | 2 |
| ..... | ................. | ................. | ...DDR | E.A.TD.AAF.. | A...A........ | 0.01 | 2 |
| TT... | F......AG.NV.N.S.R | .QAS.....NF......T | ...N.. | ............ | A...A........ | 0.01 | 2 |
| RA... | F.....ANG.NV...G.R | TQADR....NF......T | ....D. | ............ | A...A........ | 0.01 | 2 |
| ..... | F................. | .V........F....... | ...... | ............ | SARGP..AQG.Q | 0.01 | 2 |
| A.... | ................. | ................. | ...DG. | ............ | A...A........ | 0.01 | 2 |
| SA..T | F.....AGG.SI.T.G.M | .PNNG....DF......T | ....G. | ENAAAN.A.Y.S | A...A........ | 0.01 | 2 |
| N.... | F.....SKT.LM.T.N.R | TQPNH.....F....... | ...DDR | .DAG.A.I..DG | A...A........ | 0.01 | 2 |
| E.... | F.....ASA.S..T.T.G | .QPG.............. | ...D.. | E.TAE..I.... | A...A........ | 0.01 | 2 |
| D...T | F.....NKG.S..H.K.G | ..YN......F......T | ...D.R | ..ASAAD.E..D | A...A........ | 0.01 | 2 |
| GT... | F.....SAG..L.H...K | .........NF....... | ....GR | ............ | A...A........ | 0.01 | 2 |
| ..... | F................. | .V........F....... | .....S | ............ | GPHGP..DGM.. | 0.01 | 2 |
| ..... | ......STT.HA.L.T.K | ..YNH.....F....... | ....D. | .DAAGN..A..E | A...A........ | 0.01 | 2 |
| G.... | ................. | .V........F....... | ...... | .N.SGNDIE.DQ | A...A........ | 0.01 | 2 |
| GT... | F......TG.IL...T.R | .QAS.....NF......T | ....GR | .DAGA.D.EVDE | ............ | 0.01 | 2 |
| NA..T | F.....NR..N..I.T.G | .QHNH....DF....... | ....G. | ESAGAA..AY.D | A...A........ | 0.01 | 2 |
| ..... | ................. | ................T | ...AGR | E..G.SDAA.GD | A...A........ | 0.01 | 2 |
| ..... | ................. | ........DF......T | R..TDR | ............ | A...A........ | 0.01 | 2 |
| ..... | F.....DTG.PA.L.T.K | .KYT.....DF....... | ...N.. | EDAA...AAVDQ | A...A........ | 0.01 | 2 |
| RA... | F.....DKG..L.N...R | ..DGE....DF....... | ...... | E.TGAN.AE.GE | A...A........ | 0.01 | 2 |
| ..... | ................. | ................T | G..DG. | ............ | ............ | 0.01 | 2 |
| ..... | F................. | .V........F....... | ...... | ............ | ADRNG..VRM.T | 0.01 | 2 |
| DA... | F......NG.LQ.H.... | T.P......DF....... | ...D.. | ............ | ............ | 0.01 | 2 |
| ..... | ................. | ....G....NF....... | ...D.. | E..R.N.AEFGE | A...A........ | 0.01 | 2 |
| .A... | F.....DRG.S..T.A.S | ..DGE....DF....... | ...DDR | .NTNEG.IA.DE | A...A........ | 0.01 | 2 |
| RA... | ................. | ................. | ...... | E.TAAA.A..DG | A...A........ | 0.01 | 2 |
| ..... | F................. | ................T | ...N.. | .DTSANDT..DG | A...A........ | 0.01 | 2 |
| ..... | ................. | ................. | E..TD. | ............ | ............ | 0.01 | 2 |
| ..... | .......GT.NM.L.Q.G | .Q.S......F....... | ....D. | ............ | GRSAS..VEG.Q | 0.01 | 2 |
| HT... | ................. | .QAS......F....... | ...... | ESAG....A.GE | A...A........ | 0.01 | 2 |
| E.... | ................. | ........F......T | R...D. | .D.NGA.TE.GD | A...A........ | 0.01 | 2 |
| ..... | F................. | .V........F....... | ...... | ............ | GRRDG..FTE.H | 0.01 | 2 |
| T.... | F.....DAG.SA...H.R | ..HG.....NF......T | ...A.. | ............ | ............ | 0.01 | 2 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ....T | F................. | .........NF....... | ...ND. | ...TG..T..GQ | A..A........ | 0.01 | 2 |
| TT..T | ................. | .QPTG....NF....... | ...DDR | E.GNG.D.E.DS | A..A........ | 0.01 | 2 |
| ..... | ................. | ................. | R..... | .DTSTN..E..G | A..A........ | 0.01 | 2 |
| A.... | F.....DA..IA.L.K.R | .QPN......F....... | ...DG. | ............ | A..A........ | 0.01 | 2 |
| DT... | F......TG..Q.T.T.G | .Q.......DF....... | ...AD. | ............ | A..A........ | 0.01 | 1 |
| ..... | ................. | TKDDR....DF....... | ...... | ............ | A..A........ | 0.01 | 1 |
| ST... | F......GT.NM.L.Q.G | .Q.S......F....... | ....D. | ............ | ............ | 0.01 | 1 |
| ..... | ................. | ................. | ...DDR | ..AAG..AA..R | A..A........ | 0.01 | 1 |
| SA... | F.....DNT.SK.L...K | TKAGE....NF......T | R..... | ............ | G.QSP..DGA.T | 0.01 | 1 |
| GT... | F.....AEG.LK.M.H.L | ..DGE....DF....... | ...... | ............ | GRSAS..VEG.Q | 0.01 | 1 |
| DT... | ................. | ................. | R..DD. | ............ | ............ | 0.01 | 1 |
| NA..T | F.....STG.HE.L...M | ..DGE....DF....... | ...... | E.AAASD.EYGE | A..A........ | 0.01 | 1 |
| ..... | ................. | .........NF......T | ...K.. | ..GSA..I..GG | A..A........ | 0.01 | 1 |
| E.... | ................. | ................. | ...D.R | ..TAE...E..E | A..A........ | 0.01 | 1 |
| GT... | ................. | ................. | ...NDR | ..AKG...AV.. | A..A........ | 0.01 | 1 |
| ..... | ................. | .........DF....... | ...D.. | ES.AGGDAAFDQ | A..A........ | 0.01 | 1 |
| ..... | ................. | ................. | R..DD. | .D.......... | A..A........ | 0.01 | 1 |
| ..... | F.....AST.PI.K.Q.K | TQ.TH....DF....... | ...... | ............ | A..A........ | 0.01 | 1 |
| ..... | ................. | ................. | ...D.R | ERGT.A.A..GH | A..A........ | 0.01 | 1 |
| GA..T | F.....STG..N.M.T.. | ..YN......F....... | G..NDR | ............ | ............ | 0.01 | 1 |
| TA... | F.....S.A.IA.M.T.R | ..DGE....DF....... | E..ND. | E.ARGADI..GD | A..A........ | 0.01 | 1 |
| ..... | ................. | .QD.E.....F..P...E | ...D.. | ............ | ............ | 0.01 | 1 |
| E.... | ......A.......... | ................. | ...DDR | ............ | ............ | 0.01 | 1 |
| ..... | ................. | ................. | ...... | .NA.AS.A..DR | A..A........ | 0.01 | 1 |
| ..... | F......TT..V.M.T.E | T.P.....DF....... | ...D.. | ............ | A..A........ | 0.01 | 1 |
| NT... | F.....AGA.NK.L...K | .V........F....... | ...... | ENARASDA..GS | A..A........ | 0.01 | 1 |
| TA..T | ................. | .PPNG.....F......T | ...DDR | ............ | A..A......A. | 0.01 | 1 |
| EA... | ................. | .Q.DH....NF....... | ...DD. | E.AGAND.AY.N | A..A........ | 0.01 | 1 |
| ET..T | ......ANG.HL.K.K.S | ................. | E..ND. | ............ | A..A........ | 0.01 | 1 |
| DT... | F.....DHT.R..M.G.R | ................. | ...... | ............ | A..A........ | 0.01 | 1 |
| ..... | F.....DNT.SK.L...K | T.PSH....DF......T | ...DD. | ............ | A..A........ | 0.01 | 1 |
| T.... | ................. | ................. | R...D. | ............ | A..A........ | 0.01 | 1 |
| EA... | F.....DG..I..K.K.G | .QPSQ....NF....... | E..TGR | E.GAGAD...GQ | A..A........ | 0.01 | 1 |
| D.... | F.....NTG.LH.T...R | ................. | ...DD. | E.TR.N.....Q | A..A........ | 0.01 | 1 |
| T...T | F.....GTG..P.T.D.R | .Q.S......F....... | E..N.. | ............ | A..A........ | 0.01 | 1 |
| G.... | F................. | .Q.S.....DF....... | ...DD. | ES.G.AD.EFGE | A..A........ | 0.01 | 1 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| .A... | F.....DG..I..K.K.G | .QPSQ..D.NF....... | E..TGR | ............ | ............ | 0.01 | 1 |
| E.... | F......AT.SN.I.Q.R | .................. | ...... | ....T.DTEFDS | A..A........ | 0.01 | 1 |
| ..... | .................. | TQ.TG....DF....... | ...DDR | ............ | AASAG..YNN.A | 0.01 | 1 |
| ..... | F......S..PM.T.S.K | .................E | ...D.. | ............ | A..A........ | 0.01 | 1 |
| GT... | F.....AEG.LK.M.H.L | ..DGE....DF....... | ...... | ............ | TTQS...IHA.A | 0.01 | 1 |
| ..... | F.....GKT.SL...G.R | TQHTE....DF....... | R..DD. | ..AT.DD..FDG | A..A........ | 0.01 | 1 |
| ..... | .................. | .QPSQ....NF....... | ...... | E.AS.A.TAV.H | A..A........ | 0.01 | 1 |
| ..... | .................. | .................. | ...DD. | E.TGRA..A..G | A..A........ | 0.01 | 1 |
| ..... | .................. | .................. | ...D.. | EDGNGSDT..DS | A..A........ | 0.01 | 1 |
| ..... | F.....STG.NP.M.E.R | ...TE.....F....... | ...D.. | E.TTG.DAE.DN | A..A........ | 0.01 | 1 |
| AT..T | .................. | .KYT.....NF......T | ...D.R | ESATGD..E.GQ | A..A........ | 0.01 | 1 |
| ..... | .................. | .PANG.....F....... | ..ND.. | E.TD...A..DN | A..A........ | 0.01 | 1 |
| DA... | .................. | .................. | ....GR | .SAKGG.EYGD | A..A........ | 0.01 | 1 |
| ..... | .................. | .................. | E..TGR | ............ | ............ | 0.01 | 1 |
| ..... | F................. | .V........F....... | ...... | ............ | GSRAT..FDE.. | 0.01 | 1 |
| NA... | .................. | .................. | ...AG. | EDAAR.D.A.D. | A..A........ | 0.01 | 1 |
| ..... | .................. | .................. | ...... | E.TDA...AVDQ | ............ | 0.01 | 1 |
| TA... | F.....NAA.I..M.G.R | .QPN......F......T | ...N.. | ............ | A..A........ | 0.01 | 1 |
| ..... | F................. | .................. | G..TDR | E.AGGN..E.DD | A..A........ | 0.01 | 1 |
| ..... | .................K | .Q.DH....NF....... | ...DD. | ..TK...AE..D | ............ | 0.01 | 1 |
| ..... | F......QT.P..L.Q.R | TQP.R....NF......T | ...... | ............ | A..A........ | 0.01 | 1 |
| DA... | F.....ASA.S..T.T.G | .QPG.....DF....... | ....G. | ............ | ............ | 0.01 | 1 |
| ..... | F.....AG..RV.L.N.G | .QPN......F......T | ...N.. | ............ | A..A........ | 0.01 | 1 |
| GT... | .................. | .................. | R..DD. | ED.NGN.IA.D. | A..A........ | 0.01 | 1 |
| S.... | .................. | .................. | ...... | E.AS.A.TAV.H | A..A........ | 0.01 | 1 |
| G.... | .................. | TQ.GR....DF....... | ...DDR | ............ | A..A........ | 0.01 | 1 |
| NA... | F.....GG..NE.K.G.V | .QPN......F..P.... | ...... | ..AG.N..EV.S | A..A........ | 0.01 | 1 |
| ..... | .................. | .................. | ...DDR | .D.AAS..EFGQ | A..A........ | 0.01 | 1 |
| G.... | .................. | .................. | R...D. | ............ | A..A........ | 0.01 | 1 |
| E.... | F.....G.G.HA.T.G.R | .Q.GQ....DF....... | R...D. | .DGTGA..E..E | A..A........ | 0.01 | 1 |
| E.... | F................. | .V........F....... | ...... | ............ | GQHGP..SNA.H | 0.01 | 1 |
| GT..T | F.....DN...Q.N...R | ..HG.....NF......T | ...A.. | ............ | A..A........ | 0.01 | 1 |
| ..... | .................. | ..........F....... | ...... | ............ | DSRGG..FSE.. | 0.01 | 1 |
| RA... | F......AG.L..L.K.G | T.ANH....DF....... | ...... | ..AATD.AA.DQ | A..A........ | 0.01 | 1 |
| TA..T | F......A..NV...T.. | .................. | ...DDR | ............ | A..A........ | 0.01 | 1 |
| AA... | F.....AEG.LK.M.H.H | .................. | ....G. | ............ | GNQT....TG.P | 0.01 | 1 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | F................ | .V........F....... | ...... | ............ | GTRTG..NTK.D | 0.01 | 1 |
| E.... | ................ | .QPN......F......T | ...N.. | ..TG.D..A.GG | A..A........ | 0.01 | 1 |
| S.... | ................ | TKTTW....DF....... | ....D. | ...AAA.IE..Q | A..A........ | 0.01 | 1 |
| DA... | F.....AEG.LK.M.H.L | ..DGE...DF.....T | R..DD. | ............ | A..A........ | 0.01 | 1 |
| ..... | F.....SA..RA.....R | .PPNG.....F......T | ...DDR | E.AGG.D.E.DS | A..A........ | 0.01 | 1 |
| ..... | F.....DTG.SK.T.T.R | .QDT......F....... | ...... | ............ | ............ | 0.01 | 1 |
| R.... | F................ | .V........F....... | ...... | ............ | G.RN...F.V.A | 0.01 | 1 |
| ..... | ................ | .KYT......F....... | ....D. | ............ | A..A........ | 0.01 | 1 |
| TT... | F.....DRG.SD.K.K.. | .V........F....... | ...... | ............ | GPRTP..FDI.A | 0.01 | 1 |
| R.... | ................ | .KYT.....NF......T | ....G. | E.GT.ND...GG | A..A........ | 0.01 | 1 |
| AT... | ................ | .Q.S......F....... | ...DDR | ............ | A..A........ | 0.01 | 1 |
| TA..T | F.....ASA.S..T.T.G | .QPG.....DF....... | ...DDR | ............ | ............ | 0.01 | 1 |
| DT... | F.....ASA.S..T.T.G | .QPG.....DF....... | ...DDR | ............ | A..A........ | 0.01 | 1 |
| H.... | ................ | ................ | ....D. | ............ | A..A........ | 0.01 | 1 |
| ..... | F................ | .V........F....... | ...... | ............ | NRQDG..VRA.A | 0.01 | 1 |
| ..... | ................ | ................ | ...ADR | .....K...... | A..A........ | 0.01 | 1 |
| ..... | ................ | ................ | ...... | E.TGTA.AEVGE | A..A........ | 0.01 | 1 |
| ..... | ................ | .QYGQ....DF......T | ...K.. | ............ | A..A........ | 0.01 | 1 |
| ..... | ................ | ........NF....... | R...D. | .DATA..A.Y.H | A..A........ | 0.01 | 1 |
| DT... | F.....SKA.S..L.E.R | .Q.......DF....... | ...AD. | ..AGGADIEFDQ | A..A........ | 0.01 | 1 |
| ..... | ................ | .V........F....... | R...D. | ............ | A..A........ | 0.01 | 1 |
| DA... | ................ | ................ | ...D.. | .DADT..TE..H | A..A........ | 0.01 | 1 |
| NA... | ................ | ........DF....... | R...D. | ESGTTS....GG | A..A........ | 0.01 | 1 |
| AA... | F.....SS..NM.T.T.L | T..SE....NF....... | E..N.. | ............ | A..A........ | 0.01 | 1 |
| ..... | F.....NT.....K.A.R | .V........F....... | ...... | ............ | A..A........ | 0.01 | 1 |
| SA... | ................ | .KIHR....DF....... | G..ND. | ............ | A..A........ | 0.01 | 1 |
| E.... | ................ | .V........F....... | ...... | ............ | TRHTR..AEA.E | 0.01 | 1 |
| ...S. | ................ | ........K....... | ...... | ............ | ............ | 0.01 | 1 |
| TA... | F.....A...ND.T...K | .QPN......F......T | ...ADR | .D.GRA...F.. | A..A........ | 0.01 | 1 |
| TA... | ................ | ................ | E..N.. | ..TK...AE..D | ............ | 0.01 | 1 |
| ..... | F................ | .V........F....... | ...... | ............ | ARQAG..FDS.. | 0.01 | 1 |
| GA... | F.....ATT.IM.T.T.G | .........NF....... | R...D. | .DAG.S.A..DR | A..A........ | 0.01 | 1 |
| ..... | F................ | .V........F....... | ...... | ............ | KDRTH..FDM.. | 0.01 | 1 |
| ..... | ................ | ................ | ...D.. | ..ARGADAE..S | A..A........ | 0.01 | 1 |
| A.... | ................ | TQ.TG....DF....... | ...... | .NGGAADAE..H | A..A........ | 0.01 | 1 |
| ..... | F.....SGA..N...G.R | .Q.......DF....... | ...AD. | .NAAEND...GE | A..A........ | 0.01 | 1 |

TABLE 7-continued

AAV capsid proteins having increased specificity for and/or transduction of CD44+ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| TA..T | ................. | ................. | E..TG. | ........... | ........... | 0.01 | 1 |
| ..... | ................. | ................. | ...DD. | E.GGGSD.EFDG | A..A........ | 0.01 | 1 |
| ..... | ................. | ................. | N...GR | ..AG.N.AA.GQ | A..A........ | 0.01 | 1 |
| .A... | F................ | .V........F....... | ...... | ........... | .R.NG..Y.G.D | 0.01 | 1 |
| ..... | F.....NE..SD.H...K | .Q.DR.....F....... | R...D | ........... | A..A........ | 0.01 | 1 |
| ..... | ................. | .V........F....... | ...... | ........... | GAKGN..SG..T | 0.01 | 1 |
| G.... | ......SS..SV.P.D.H | .QPG............. | ...... | ........... | A..A........ | 0.01 | 1 |
| ..... | F......GA.NN...G.R | .QHNQ.....F....... | E..ND. | ........... | A..A........ | 0.01 | 1 |
| ..... | F................ | .QAS......F......T | ...ND. | .NTGR..AA..Q | A..A........ | 0.01 | 1 |
| GT... | F................ | .QANH....DF....... | ...DDR | ........... | A..A........ | 0.01 | 1 |
| ..... | F.....SR...V.P.G.M | ..PN.....NF....... | E..AG. | .SAKAA.AA.DE | A..A........ | 0.01 | 1 |
| TA... | F.....GRG.NI.K.P.H | TQ.TG....DF....... | ...DDR | ...G.S..AFGD | A..A........ | 0.01 | 1 |
| TT..T | ................. | ...V.....NF....... | R...D | ........... | A..A........ | 0.01 | 1 |
| ..... | ................. | ................. | ...DD | EDATGS.IA.DQ | A..A........ | 0.01 | 1 |
| GA..T | F.....AG..L.T.N.R | .QANH.....F.....T | ...D. | .NTGG.....GQ | A..A........ | 0.01 | 1 |
| TA..T | F.....DGT.SM.N.G.R | ..PNG....DF....... | ...D. | .S.SGN.I..GH | A..A........ | 0.01 | 1 |
| GA... | F.....DQ..R..P.S.R | .Q.DR.....F....... | ....D | ........... | A..A........ | 0.01 | 1 |
| T...T | ................. | ................. | R..DDR | ESTARN.A.V.Q | A..A....E... | 0.01 | 1 |
| ..... | ................. | ................. | D..DG. | ........... | A..A........ | 0.01 | 1 |
| ..... | ................. | .V.......DF....... | ...D.. | .D.GRN.A.FDG | A..A........ | 0.01 | 1 |
| ..... | ................. | .........F....... | R..AD. | ........... | A..A........ | 0.01 | 1 |
| ..... | F................ | .V........F....... | ...... | ........... | GPKA...D.R.Q | 0.01 | 1 |
| ST... | F.....GHA.SK.T.E.K | .Q.S......F....... | E..N.. | EDAKGND.A..N | A..A........ | 0.01 | 1 |
| A.... | F................ | .V........F....... | .Y.... | ........... | GRKNA..FQN.E | 0.01 | 1 |
| D...T | F.....ASA.S..T.T.G | .QPG............. | ...... | ........... | A..A........ | 0.01 | 1 |
| D...T | F.....SD..HP.L.Q.K | .Q.DH....NF....... | ...DD | ........... | A..A........ | 0.01 | 1 |
| H.... | ................. | ................. | ...DDR | ........... | TRRDP..DNM.T | 0.01 | 1 |
| ..... | ................. | .............R... | ...... | ..TNESD..... | ........... | 0.01 | 1 |
| GT... | F.....AEG.LK.M.H.L | ................. | ...... | ........... | A..A....EI.K | 0.01 | 1 |
| ..... | ................. | ................. | G..NDR | E..GGG..EF.D | A..A........ | 0.01 | 1 |
| ..... | F................ | .V........F....... | ...... | EDAG.AD.E.G. | A..A........ | 0.01 | 1 |
| ..... | F.....GGG.NV.K.Q.G | T.YNH.....F....... | ...D.. | ........... | A..A........ | 0.01 | 1 |
| GT... | ................. | ...V.....NF....... | R...D | ........... | A..A........ | 0.01 | 1 |
| ..... | ................. | .Q.S......F....... | E..N.. | .DASGSD..Y.R | A..A........ | 0.01 | 1 |
| DT... | ......DA..IA.L.K.R | .QPN......F....... | ...DG. | ........... | A..A........ | 0.01 | 1 |
| D.... | F.....GA..SQ.H.G.M | .PANG............ | ...... | ..TGAS..EV.N | A..A........ | 0.01 | 1 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| ..... | F......KT.NV.K.T.H | ................. | ...AG. | .SAKAA.AA.DE | A..A........ | 0.01 | 1 |
| G.... | ................. | .QDT......F....... | ...... | ............ | G.RDE..DRT.. | 0.01 | 1 |
| NA..T | ................. | ................. | ....GR | ............ | A..A........ | 0.01 | 1 |
| ..... | ................. | .QP.G.....F....... | R..DDR | ............ | A..A........ | 0.01 | 1 |
| ..... | F................ | .V........F....... | ...... | ............ | GKQGG..NKA.. | 0.01 | 1 |
| ..... | F.....SD..NP.H.D.R | ..YN......F......T | ...D.R | ENAGRAD.AFD. | A..A........ | 0.01 | 1 |
| ..... | F.....DG..I..K.K.G | .QPSG....NF....... | E..TGR | E.GAGAD...GQ | A..A........ | 0.01 | 1 |
| E.... | ................. | ................. | ....D. | ............ | A..A........ | 0.01 | 1 |
| GT... | F.....SGT.S..P.A.K | ..HG.....NF....... | ...... | E........... | A..A........ | 0.01 | 1 |
| A.... | F.....SA..RA.....R | ..YN......F......T | ...... | ............ | A..A........ | 0.01 | 1 |
| ..... | F................ | .V........F....... | ...... | ............ | GTRGG..FGM.H | 0.01 | 1 |
| D...T | F.....ASA.S..T.T.G | .QPG.....DF....... | ...DDR | ......A..... | A..A........ | 0.01 | 1 |
| RA... | ................. | ................. | ...D.. | ............ | A..A........ | 0.01 | 1 |
| ..... | ................. | ................. | ...DG. | ............ | GTRGT..ADA.Q | 0.01 | 1 |
| TT... | F.....NDG.PA.K.T.R | ..PN.....NF....... | ...NDR | ............ | A..A........ | 0.01 | 1 |
| GA... | F................ | .V........F....... | ...... | ............ | ARSNR..FDV.H | 0.01 | 1 |
| A.... | F.....DAA.IK.T.Q.N | ..DGE....DF....... | ...... | E........... | ............ | 0.01 | 1 |
| ..... | F.....NGG.NN.K.T.R | .V........F....... | ...... | ............ | A..A........ | 0.01 | 1 |
| ..... | ................. | TQP.R....NF......T | R...D. | ..A.G...AYD. | A..A........ | 0.01 | 1 |
| SA... | ................. | ................. | ...... | ..GGTD....DR | A..A........ | 0.01 | 1 |
| ..... | F.....S.T.NV.L.D.. | .QPSQ....NF....... | R...G. | .SG..ND...DG | A..A........ | 0.01 | 1 |
| E.... | ................. | ................. | ....GR | ..AG.N.AA.GQ | A..A........ | 0.01 | 1 |
| H.... | ................. | ................. | G..KD. | ESAGAN....GG | A..A........ | 0.01 | 1 |
| ..... | ................. | ................. | ...D.. | ESTGGN..AVGQ | A..A........ | 0.01 | 1 |
| D...T | F.....ASA.S..T.T.G | ................. | ....D. | .DGKGS.IA..G | A..A........ | 0.01 | 1 |
| ..... | F.....AG..RV.L.N.G | .QPN......F......T | ...N.. | E..GASD.A..Q | ............ | 0.01 | 1 |
| ..... | F................ | ................. | ...N.. | ............ | A..A........ | 0.01 | 1 |
| ..... | F................ | .........D....... | ...D.. | ............ | A..A........ | 0.01 | 1 |
| EA... | F......A..NV...T.. | ................. | ...DDR | ............ | A..A........ | 0.01 | 1 |
| ..... | F................ | ................. | ...DDR | .DAKGN..EVGQ | A..A........ | 0.01 | 1 |
| DT... | F.....DRG.S..T.A.S | ..DGE....DF....... | ...... | ............ | ............ | 0.01 | 1 |
| ..... | ................. | ................. | R..AG. | ............ | A..A.T...... | 0.01 | 1 |
| TA... | F................ | .V........F....... | ...... | ............ | ............ | 0.01 | 1 |
| ..... | F................ | .V........F....... | ...... | ............ | GHRD...DKG.D | 0.01 | 1 |
| ..... | F................ | ..........F....... | R..AGR | .NA.RA.T..G. | A..A........ | 0.01 | 1 |
| D...T | F................ | .V........F....... | ...... | ............ | ..RAP..FSE.. | 0.01 | 1 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| E.... | F.....DRG.S..T.A.S | ..DGE....DF....... | ...... | .......... | ............ | 0.01 | 1 |
| ..... | F.....NKG.N..K.G.G | .........NF....... | R...D. | .......... | A..A........ | 0.01 | 1 |
| TT... | F.....GGG.L..T.E.R | TQ.TG....DF....... | ...DDR | .......... | A..A........ | 0.01 | 1 |
| ..... | .................. | .V........F....... | ...DDR | E.GAEGD..FDG | ............ | 0.01 | 1 |
| ..... | F................. | .V........F....... | R..... | .......... | KPHSP..VSE.T | 0.01 | 1 |
| .A... | .................. | .................. | R...DR | .......... | A..A........ | 0.01 | 1 |
| ..... | F.....A........... | .V........F....... | ...... | .......... | TNRDA..ANT.T | 0.01 | 1 |
| RA... | .................. | .K.TG....DF....... | R...DR | ESAN...I...H | A..A........ | 0.01 | 1 |
| ..... | .................. | .........DF....... | ...DDR | .STSA..AAY.D | A..A........ | 0.01 | 1 |
| ..... | .................. | ..P.G....NF....... | E..DDR | .NA.AS.A..DR | A..A........ | 0.01 | 1 |
| A.... | .................. | .................. | ...D.. | .N.TAN...VGS | A..A........ | 0.01 | 1 |
| ..... | ......GK..LA.K.N.G | .................. | ...... | ..AGT.D.EYGQ | A..A........ | 0.01 | 1 |
| ..... | F................. | .V................ | R...DR | .DA.TSD..VDR | A..A........ | 0.01 | 1 |
| E.... | F.....GH..P..P.S.V | ..AGR....DF......T | R..D.. | .D......... | A..A........ | 0.01 | 1 |
| ..... | .................. | .V........F....... | ...... | ESGTAND...DR | A..A........ | 0.01 | 1 |
| TA... | F................. | .V........F....... | ...... | .......... | SRQNT...TN.D | 0.01 | 1 |
| ..... | .................. | .................. | G..NDR | ED.GGVD.E.DR | ............ | 0.01 | 1 |
| ..... | .................. | .................. | RTMRAG | .......... | A..A........ | 0.01 | 1 |
| EA... | F.....SN..PL.K.T.. | .Q.DR.....F....... | ....D. | ...NRAD.E..Q | ............ | 0.01 | 1 |
| ..... | .................. | TK.NE....DF......T | ...... | ..AGAN..A.GD | A..A........ | 0.01 | 1 |
| TA..T | .................. | .QPN......F......T | ...N.. | ..TG.D..A.GG | A..A........ | 0.01 | 1 |
| ..... | F.....GRT.PQ.T.T.R | ..YN.............. | G..DG. | .......... | ............ | 0.01 | 1 |
| ..... | .................. | .................. | ....D. | ..AKG...AV.. | A..A........ | 0.01 | 1 |
| GA... | F.....ATT.IM.T.T.R | .........NF....... | R...D. | .DAG.G.A..DR | A..A........ | 0.01 | 1 |
| NA... | .................. | .........NF......T | ...K.. | ..GSA..I..GG | A..A........ | 0.01 | 1 |
| SA... | .................. | .QPN......F......T | ...N.. | .DTG.N..A..R | A..A........ | 0.01 | 1 |
| D.... | F.....SK..LD.L.T.G | .QPN......F......T | ...... | .......... | A..A........ | 0.01 | 1 |
| ..... | .............T.R | ..PN......NF....... | ...DD. | ES.A...AAYGE | A..A........ | 0.01 | 1 |
| EA... | .................. | .QHNQ.....F......T | ...D.. | .DGARDDAA..D | A..A........ | 0.01 | 1 |
| ..... | F................. | .V........F....... | ...... | .......... | GPKSR..DDV.T | 0.01 | 1 |
| CA... | .................. | .................. | E..KG. | .......... | ............ | 0.01 | 1 |
| TA..T | F.....AGG.IV.L.G.R | ..DGE....DF....... | ...... | .......... | A..A........ | 0.01 | 1 |
| GT... | F.....AEG.LK.M.H.L | .QPG.....DF....... | ...DDR | .......... | ............ | 0.01 | 1 |
| ..... | .................. | .................. | ...... | .DGGGS.AAFDE | A..A........ | 0.01 | 1 |
| ..... | F................. | .V........F....... | ...... | .......... | GAHDG..ARG.Q | 0.01 | 1 |
| DT... | F.....DDG.LA.K...R | .................. | ...... | .......... | A..A........ | 0.01 | 1 |

TABLE 7-continued

AAV capsid proteins having increased specificity for and/or transduction of CD44+ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | ................. | .KDSR....DF......T | R..DD. | ........... | A..A........ | 0.01 | 1 |
| TA... | ................. | .QANH....DF....... | ...DDR | ........... | ............ | 0.01 | 1 |
| G.... | F.....AHA.SH.M.S.R | ..DGE....DF....... | ...... | E.AA.DD.AV.. | A..A........ | 0.01 | 1 |
| .A... | ................. | ..A......DF....... | G..N.. | ........... | A..A........ | 0.01 | 1 |
| GA..T | ................. | .QPN......F......T | ...N.. | .DTG.N..A..R | A..A........ | 0.01 | 1 |
| NA... | F.....NT...M.M...R | ..DGE....DF....... | ....D. | .N.ARS..E.GG | A..A........ | 0.01 | 1 |
| ..... | ................. | ................. | ...N.. | ........... | P..A........ | 0.01 | 1 |
| GT..T | ................. | ................. | ...... | ...TG..T..GQ | A..A........ | 0.01 | 1 |
| ..... | ................. | .QPNQ....NF......T | ...N.. | E.TD.A....DG | A..A........ | 0.01 | 1 |
| ST..T | F.....DA..IA.L.K.R | TQ.TH....DF....... | R..ADS | ........... | A..A........ | 0.01 | 1 |
| ..... | ......AEG.LK.M.H.L | ..DGE....DF....... | ...DD. | ........... | ............ | 0.01 | 1 |
| ..... | .......GT.NM.L.Q.G | .Q.S......F....... | ....D. | ........... | ............ | 0.01 | 1 |
| ..... | ................. | TQDS.....NF....... | ...DDR | E........... | A..A........ | 0.01 | 1 |
| ..... | ................. | ..PNG....DF....... | ...DDR | E.ADGS..E.GN | A..A........ | 0.01 | 1 |
| E.... | ................. | ................. | R..NG. | ........... | ............ | 0.01 | 1 |
| TA... | F.....DMG.S..T.A.S | ..DGE....DF....... | ...... | ........... | ............ | 0.01 | 1 |
| SA... | ................. | ................. | ...D.. | E.TAE..I.... | A..A........ | 0.01 | 1 |
| GA..T | ................. | ................. | ...N.. | EDGKGA....GE | A..A........ | 0.01 | 1 |
| RA... | F.....AGA.NK.L...K | .QAS.....NF......T | ...... | ........... | A..A........ | 0.01 | 1 |
| D...T | F.....ASA.S..T.T.G | .QPG.....DF....... | ...DDR | ........... | ............ | 0.01 | 1 |
| G.... | ................. | .QPG.....NF....... | ...DDR | EDATRS..E..G | A..A........ | 0.01 | 1 |
| .A... | F.....GK..NE.L.Q.V | .QPG.....NF....... | ...D.. | E.TGA.D.EYDQ | A..A........ | 0.01 | 1 |
| TA... | ................. | ................. | E..TD. | ........... | A..A........ | 0.01 | 1 |
| RA... | ......GRT.S..L.G.R | .QANH.....F......T | E..T.. | ........... | A..A........ | 0.01 | 1 |
| A.... | ................. | TQ.TG....DF....... | ...DDR | ..AGT.D.EYGQ | A..A........ | 0.01 | 1 |
| ..... | F................. | .V........F....... | ...DD. | E.GGSD.EFDG | A..A........ | 0.01 | 1 |
| ..... | F................. | .V........F....... | R..DD. | ........... | E.RS...F.E.H | 0.01 | 1 |
| ..... | ................. | ................. | G..DG. | .DANRN..E.GQ | A..A........ | 0.01 | 1 |
| TA... | ................. | ................. | ...D.R | E.AG..D.A.GR | A..A........ | 0.01 | 1 |
| .A... | F.....DG..I..K.K.G | .QPSQ....NF....... | E..TGR | E.GAGAD...GQ | A..A........ | 0.01 | 1 |
| .A..T | F.......I......... | .........F....... | ...... | ENGGTN..E.GN | A..A........ | 0.01 | 1 |
| DA... | F.....NTG.LH.T...R | T.ASH....DF....... | R..DD. | ........... | A..A........ | 0.01 | 1 |
| A.... | ................. | .QPGQ....NF....... | E..AD. | .SASEN.I..DR | A..A........ | 0.01 | 1 |
| NT... | F................. | ................. | R..TG. | ........... | A..A........ | 0.01 | 1 |
| GA..T | F.....GTG..P.T.D.G | .QPG.....DF....... | ...D.. | ........... | ...A........ | 0.01 | 1 |
| DT... | F................. | ................. | E..N.. | ........... | A..A........ | 0.01 | 1 |

TABLE 7-continued

AAV capsid proteins having increased specificity for and/or transduction of
CD44<sup>+</sup> GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| G.... | .................. | .........DF....... | ....D. | ESGS.S.IA.DQ | A..A........ | 0.01 | 1 |
| ....T | F................. | .................. | ....D. | ............ | A..A........ | 0.01 | 1 |
| ..... | .................. | .................. | ...D.. | .N.TAN...VGS | A..A........ | 0.01 | 1 |
| TA... | .................. | .................. | R..N.. | .D.TGN.I...Q | A..A........ | 0.01 | 1 |
| E.... | .................. | .................. | G..KD. | ESAGAN....GG | A..A........ | 0.01 | 1 |
| GA..T | F......QG.NQ...A.R | .................. | E..DDR | .NA.AS.A..DR | A..A........ | 0.01 | 1 |
| ..... | .................. | .................. | ...... | E.AAASDAAY.N | A..A........ | 0.01 | 1 |
| RA... | F.....NAG.LL.T.H.K | .................. | G...G. | ............ | ............ | 0.01 | 1 |
| DT... | F.....NN..N..M...G | .................. | E..KD. | ............ | A..A........ | 0.01 | 1 |
| ..... | .................. | .................. | E..ND. | .SAGAA.IA..Q | A..A........ | 0.01 | 1 |
| GA... | .................. | .................. | ...DDR | E.A.AD.AAF.. | A..A........ | 0.01 | 1 |
| ..... | .................. | .................. | G..DD. | EDAG.AD.E..R | ............ | 0.01 | 1 |
| ..... | F.....GG..NK.M.... | .QPSE....DF....... | R..D.. | ............ | A..A........ | 0.01 | 1 |
| ..... | F................. | .V........F....... | ...... | ............ | GKRD...AGE.K | 0.01 | 1 |
| ..... | .................. | .................. | G..TDR | E.AGGN..E.DD | ....R....... | 0.01 | 1 |
| EA... | .................. | T..SG....DF......T | ...ADR | .SGATG...FDG | A..A........ | 0.01 | 1 |
| E.... | F.....AA..IQ.T.K.R | T.ASH....DF....... | ...... | ..ASE...E.D. | A..A........ | 0.01 | 1 |
| ET... | F.....GG..I..P...R | .PPN......F......T | ...ADR | ENAGRSD..FGG | A..A........ | 0.01 | 1 |
| ..... | .................. | .................. | R...GR | EDTG.A....GN | A..A........ | 0.01 | 1 |
| ..... | .................. | .................. | G..K.. | ..GNGN..E..S | A..A........ | 0.01 | 1 |
| ..... | .................. | .................. | ...DDR | .DAKGN..EVGQ | AA.A........ | 0.01 | 1 |
| TT..T | F.....ASA.S..T.T.G | .QPG.....DF....... | ...DDR | ............ | ............ | 0.01 | 1 |
| EA... | F................. | .................. | ...D.. | ............ | A..T........ | 0.01 | 1 |
| GT... | .................. | TQPGG............. | ...DDR | E..TAA.AAFD. | A..A........ | 0.01 | 1 |
| ..... | .................. | ..HG.....NF.....T | ...TDR | .SA....AEVDD | A..A........ | 0.01 | 1 |
| AA... | F.....NKG.N..K.G.G | .........NF....... | R...D. | ............ | A..A........ | 0.01 | 1 |
| ..... | .................. | ...V.....DF....... | ...DD. | .D..R.D.E... | A..A........ | 0.01 | 1 |
| A...T | .................. | .................. | ...AG. | ............ | A........... | 0.01 | 1 |
| ..... | .................. | .QYGQ....DF......T | E..TGR | ...R.G.....E | A..A........ | 0.01 | 1 |
| ..... | .................. | .V........F....... | R..ND. | ..AG...IYAGN | A..A........ | 0.01 | 1 |
| ..... | F.....DTG.PA.L.T.K | ..DGE....DF....... | ...... | E.AGAND.AY.N | A..A........ | 0.01 | 1 |
| H.... | ......NKT.I....... | .........DF....... | ...D.R | .DANRN.A.VDH | A..A........ | 0.01 | 1 |
| NA... | F................. | ..AGR...........T | E..D.. | ............ | A..A........ | 0.01 | 1 |
| RA... | F................. | .V........F....... | R..ND. | ..AG...IAYGN | A..A........ | 0.01 | 1 |
| ..... | .................. | .................. | G..TDR | E.AGGN..E.DD | A..A........ | 0.01 | 1 |
| TA..T | .................. | .........NF....... | R...D. | EDGGGS..E.GR | A..A........ | 0.01 | 1 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| AA... | ......DHT..D.P...R | ...NG.....F.R..... | R...D. | EDAR.D..EVGE | A..A........ | 0.01 | 1 |
| E.... | F.....AEG.LK.M.H.L | ..DGE....DF....... | ...... | ............ | A..A........ | 0.01 | 1 |
| ST... | F.....ASA.S..T.T.G | .QPG.....DF....... | ...DDR | ............ | ............ | 0.01 | 1 |
| DT... | F.....GKA.SE.N...K | T.AG.....NF......T | ...N.. | ............ | A..A........ | 0.01 | 1 |
| E.... | F.....GN..RM.T...E | ..HG.....NF......T | ...A.. | E.AG...IA.DD | A..A........ | 0.01 | 1 |
| A.... | .................. | .................. | ....GR | ..AG.N.AA.GQ | A..A........ | 0.01 | 1 |
| E.... | F.....ASA.S..T.T.G | .QPG.....DF....... | G..N.. | ............ | ............ | 0.01 | 1 |
| E.... | .................. | .................. | R..D.. | ESAAGD.IE.GD | A..A........ | 0.01 | 1 |
| ..... | .................. | .V........F....... | ...... | ............ | THRAT..ADG.Q | 0.01 | 1 |
| ..... | .................. | .................. | E..N.. | ............ | A..A........ | 0.01 | 1 |
| GT..T | F.....GRG.SP.K...G | .QPG.....NF....... | ...DDR | ............ | DRRSA..YTT.Q | 0.01 | 1 |
| ..... | ..........NAVKAS | .................. | E..ND. | ............ | A..A........ | 0.01 | 1 |
| DA..A | F.....STA..Q.H.Q.L | .................. | ...A.. | .N.KA.DAE..D | A..A........ | 0.01 | 1 |
| ..... | F................. | .................. | G..N.. | ............ | ............ | 0.01 | 1 |
| ..... | .................. | .................. | ...D.R | ESGKAS..A.GE | A..A........ | 0.01 | 1 |
| GT... | F.....SA..RA.....R | ...DG....DF....... | R..TDR | ..A.AN..AV.Q | GAKGN..SG..T | 0.01 | 1 |
| ..... | .................. | .........DF....... | ...... | ............ | ............ | 0.01 | 1 |
| TA... | F.........NL.T.S.L | ..A......DF....... | ...D.. | .STREGD....N | A..A........ | 0.01 | 1 |
| ..... | F.....NGG.IM.L.E.R | ..DGE....DF....... | ...... | ENAAAN.A.Y.S | A..A........ | 0.01 | 1 |
| A.... | F.....DGT.SM.N.G.R | .KDDG....NF......T | E..AG. | ............ | ............ | 0.01 | 1 |
| AT... | F.....DR..II...A.R | ..HG.....NF......T | ...A.. | ............ | A..A........ | 0.01 | 1 |
| TA... | .................. | ..DGE....DF....... | R...D. | ............ | ............ | 0.01 | 1 |
| ..... | .................. | .........F....... | R..TG. | ..ATAA..AVDN | A..A........ | 0.01 | 1 |
| ..... | .................. | .................. | ...DG. | ESTARN.A.V.Q | A..A....E... | 0.01 | 1 |
| GA... | F.....GT..I..N.T.G | .V........F....... | ...... | .SGS.NDIA..D | A..A........ | 0.01 | 1 |
| ..... | .................. | TKAT.....NF......T | R..AG. | E..G.DD.EYDQ | A..A........ | 0.01 | 1 |
| ..... | F.....ATT.NV.T.K.S | .Q.DR.....F....... | ....D. | E.TGAN.AE.GE | A..A........ | 0.01 | 1 |
| A.... | F.....AEG.NI.L.K.R | TPPSQ....NF......T | ...DDR | ............ | TRRDP..DNM.T | 0.01 | 1 |
| ..... | F......AT.IA.P.K.M | .........NF....... | R...D. | ............ | A..A........ | 0.01 | 1 |
| ..... | F................. | .V........F....... | ...... | ............ | SERTG..DGT.T | 0.01 | 1 |
| SA..T | .................. | .................. | R..DD. | ............ | A..A........ | 0.01 | 1 |
| ....T | F.....DGA.RN.T.S.G | ..HG.....NF....... | ...D.. | ............ | A..A........ | 0.01 | 1 |
| NT... | F................. | .V........F....... | ...... | ............ | GARGE..YNV.A | 0.01 | 1 |
| ..... | F.....GS..NM.N.T.R | ..DGE....DF....... | ...... | E.TTGNDI...R | A..A........ | 0.01 | 1 |
| ..... | .................. | .................. | G..D.R | ..ASE...E.D. | A..A........ | 0.01 | 1 |
| TT... | .................. | .................. | ...NDR | ..AKG...AV.. | A..A........ | 0.01 | 1 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| AT... | F.....AEG.LK.M.H.L | ..DGE....DF....... | ...... | ............ | ............ | 0.01 | 1 |
| RA... | F.....DK..P..M.T.R | .QPN......F......T | ...N.. | ESATGG.T..GG | A..A........ | 0.01 | 1 |
| ..... | F.....DDG.LA.K...R | .................. | ...... | ............ | A..A........ | 0.01 | 1 |
| AT... | .................. | ..AGR.....F....... | ....GR | ............ | A..A........ | 0.01 | 1 |
| E.... | ......DQ..R..P.S.R | ..DGE....DF....... | ...... | .N.ARS..E.GQ | A..A........ | 0.01 | 1 |
| ..... | .................. | ................E. | R...AG. | ............ | A..A........ | 0.01 | 1 |
| ..... | F......NG.LQ.H...N | T.P......DF....... | ...D.. | ............ | A..A........ | 0.01 | 1 |
| SA... | .................. | .................. | ...... | E.AS.A.TAV.H | A..A........ | 0.01 | 1 |
| AA... | .................. | ...T.....NF......T | ...DDR | .SAKAA.AA.DE | A..A........ | 0.01 | 1 |
| ..... | .................. | .................. | ...... | ESGGAD.I...R | A..A........ | 0.01 | 1 |
| ..... | F.....GHG.NK.I.N.R | ..PSH....DF....... | ....D. | ............ | A..A........ | 0.01 | 1 |
| D...T | .................. | TQ.TH....DF....... | ....D. | EN.GTN.AE.DN | A..A........ | 0.01 | 1 |
| ..... | .................. | .................T | R...AG. | E.ASG..I.VGR | A..A........ | 0.01 | 1 |
| ..... | .................. | .................. | ...... | ..GTAG...V.G | A..A........ | 0.01 | 1 |
| N.... | .................. | .................. | G..K.. | E.AGRDD..V.E | A..A........ | 0.01 | 1 |
| .A... | F......GT.NM.L.Q.G | .Q.S.....NF......T | ...... | ............ | A..A........ | 0.01 | 1 |
| S.... | .................. | .................T | ...D.. | ............ | ............ | 0.01 | 1 |
| GT... | .................. | .................. | R...GR | EDGDGA..A.DR | A..A........ | 0.01 | 1 |
| ..... | .................. | ..PNG....DF....... | G..NDR | ............ | ............ | 0.01 | 1 |
| H.... | F................. | ..DGE....DF....... | ...... | E.TDAND..VGQ | A..A........ | 0.01 | 1 |
| E.... | .................. | .................. | G..DD. | ............ | A..A........ | 0.01 | 1 |
| ..... | .................. | .........DF....... | E..ND. | ............ | ............ | 0.01 | 1 |
| A.... | F.....DA..IA.L.K.R | .................. | ...N.. | ............ | A..A........ | 0.01 | 1 |
| E.... | F......SA.S..T.T.G | .QPG.....DF....... | ...DDR | ............ | ............ | 0.01 | 1 |
| N.... | F.....DTT.LH.K.T.G | .Q.S......F....... | E..N.. | ............ | A..A........ | 0.01 | 1 |
| SA... | F.....GRG.NI.K.P.H | .V........F....... | ...... | ............ | A..A........ | 0.01 | 1 |
| ..... | F................. | .V.........F...... | ...... | ............ | GNHSP..D.M.Q | 0.01 | 1 |
| ..... | .................. | .................. | ...D.. | E.TAGN.IE.DG | A..A........ | 0.01 | 1 |
| ..... | ...........R..... | ..DGE....DF....... | ...... | ..AG.DD...GG | A..A........ | 0.01 | 1 |
| GA... | .................. | .........F........ | ...... | ............ | ANSNP..SDS.Q | 0.01 | 1 |
| D...T | .................. | .........DF......T | E..NG. | E.GKA....FDG | A..A........ | 0.01 | 1 |
| A.... | .................. | .................. | R..DD. | E.GAR.D.E.GE | A..A........ | 0.01 | 1 |
| ..... | F................. | .................. | E..DGR | ............ | ............ | 0.01 | 1 |
| RA... | .................. | .................. | G..KD. | ESAGAN....GG | A..A........ | 0.01 | 1 |
| ..... | F.....STG..N.M.T. | .K.TG....DF....... | ...... | ............ | A..A........ | 0.01 | 1 |
| ..... | F.....SRT..A...T.N | T.P......DF....... | ...D.. | ............ | ............ | 0.01 | 1 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263<br>QSGAS | 444<br>YLSRTNTPSGTTTQSRLQ | 490<br>KTSADNNNSEYSWTGATK | 527<br>KKDEEK | 545<br>QGSEKTNVDIEK | 585<br>RGNRQAATADVN | % | # |
|---|---|---|---|---|---|---|---|
| TA... | F................. | .V................ | R...D. | E.AG..D.A.GR | A..A........ | 0.01 | 1 |
| D.... | .................. | .................. | ....D. | ..ARRNDAEFGS | A..A........ | 0.01 | 1 |
| GA... | F.....S.T.NV.L.D.. | .QPSQ....NF....... | ...... | E.AS.A.TAV.H | A..A........ | 0.01 | 1 |
| ..... | .................. | ........DF....... | ...... | ..AST..AA..D | A..A........ | 0.01 | 1 |
| N.... | .................. | .................. | ...DD. | ES.A...AAYGE | A..A........ | 0.01 | 1 |
| ..... | F................. | .V........F....... | .....S | .SA.GG....DG | A..A........ | 0.01 | 1 |
| ..... | .................. | .QANH.....F......T | R..D.. | .SAKAA.AA.DE | A..A........ | 0.01 | 1 |
| ..... | F................. | .V........F....... | E..ND. | E.AGGND....R | A..A........ | 0.01 | 1 |
| ..... | .................. | .................. | ...DG. | .N.GA.D.A.GG | A..A........ | 0.01 | 1 |
| GT... | .................. | .Q.S......F....... | ....D. | ............ | ............ | 0.01 | 1 |
| D...T | F......GT.NM.L.Q.G | .V........F....... | ...... | ............ | TEHNP..FRS.T | 0.01 | 1 |
| ..... | .................. | ..PN....NF....... | R...D. | ESTGGND.EYDQ | A..A........ | 0.01 | 1 |
| ..... | F.....EA.SL.K.Q.R | ..DDG....DF....... | ...DDR | ............ | ............ | 0.01 | 1 |
| T...T | F.....GTG..P.T.D.R | .Q.S......F....... | E..N.. | ............ | TPRNN...EV.D | 0.01 | 1 |
| ..... | .................. | ........DF....... | ...A.. | ............ | GPRTG...HT.E | 0.01 | 1 |
| ..... | .................. | .................. | ...DDR | E..GGND....R | A..A........ | 0.01 | 1 |
| RA... | .................. | ..DGE....DF....... | R...D. | ............ | ............ | 0.01 | 1 |
| ET..T | .................. | .................. | ...D.R | ............ | A..A........ | 0.01 | 1 |
| GT... | .................. | .Q.D.....DF..P.... | ...A.. | ............ | ............ | 0.01 | 1 |
| GA... | F.....STT.HV.K...I | .QAS......F....... | ...DD. | ENASG.....GN | A..A........ | 0.01 | 1 |
| TA... | .................. | ..........F....... | E..TD. | ............ | ............ | 0.01 | 1 |
| ..... | F................. | .V........F....... | ...DDR | ESGGTD....DR | A..A........ | 0.01 | 1 |
| .A... | .................. | .................. | E..KG. | ............ | ............ | 0.01 | 1 |
| ..... | F.....NET.NA.P...K | ..HG.....NF......T | ...A.. | ............ | A..A........ | 0.01 | 1 |
| ..... | .................. | TQP.R....NF......T | ...D.. | ............ | A..A........ | 0.01 | 1 |
| TA..T | F................. | .V........F....... | ...... | ............ | SRQNT...TN.D | 0.01 | 1 |
| .A... | F.....DH..ID.K...V | T.PGG....NF....... | ...DG. | ESGGGN.IA.DQ | A..A........ | 0.01 | 1 |
| ..... | F................. | .V........F....... | ...... | ............ | TRSSG..SNA.D | 0.01 | 1 |
| EA... | F.....DAA.IK.T.Q.N | ..DGE....DF....... | ...N.. | ............ | A..A........ | 0.01 | 1 |
| E.... | F.....AEG.LK.M.H.L | ..DGE....DF....... | .....S | ............ | ............ | 0.01 | 1 |
| G.... | F................. | ..HG.....NF......T | ...A.. | ..AG.SD.EVG. | A..A........ | 0.01 | 1 |
| ..... | F.....AEG.LK.M.H.L | ..........F....... | ...... | ............ | A..A........ | 0.01 | 1 |
| EA... | ......SG..IK.K.D.R | .KPDQ....DF....... | ...D.. | .NATG....VGS | A..A........ | 0.01 | 1 |
| ..... | .................. | .................. | ....R. | E.ADGA..AYDR | A..A........ | 0.01 | 1 |
| ..... | F.....DRG.SL.M...I | .................. | ...NDR | ............ | A..A........ | 0.01 | 1 |
| ..... | .................. | .Q.GQ....DF....... | R..ND. | ..AK.ADT..GN | A..A........ | 0.01 | 1 |

TABLE 7-continued

AAV capsid proteins having increased specificity for and/or transduction of CD44⁺ GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| AA..T | F.....GS..NK.M.A.R | ..AGR....DF......T | R..D.. | ........... | A..A........ | 0.01 | 1 |
| ..... | ................. | .........NF....... | R..D. | ........... | A..A........ | 0.01 | 1 |
| ..... | ................. | ................. | E..NG. | ENASGG.AE.DS | ........... | 0.01 | 1 |
| ..... | ................. | ................. | ....D. | .D..TD....GD | A..A........ | 0.01 | 1 |
| D...T | ................. | ................. | R..DD. | ........... | ........... | 0.01 | 1 |
| .A... | F................. | .V........F....... | ....D. | ........... | A..A.......A. | 0.01 | 1 |
| ..... | ................. | T.AG......F......T | ...DD. | ..TKRDD.A.DE | A..A........ | 0.01 | 1 |
| DT... | F.....GKG.ND.T.N.G | ..ATR...DF....... | E..N.. | ........... | A..A........ | 0.01 | 1 |
| GT... | ................. | .PPNG.....F......T | ...DDR | E.TR.N.....Q | A..A........ | 0.01 | 1 |
| ..... | F.....STA..Q.H.Q.L | ..DGE............T | ...AGR | ........... | A..A........ | 0.01 | 1 |
| ET... | F......QT..M.T...R | .KDT......F......T | ...DD. | E....ND.EF.Q | A..A.....E.. | 0.01 | 1 |
| SA... | ................. | ...............T | ....D. | E.TGRA..A..G | A..A........ | 0.01 | 1 |
| ..... | F................. | ................. | E..NG. | ..ANR.D...DR | A..A........ | 0.01 | 1 |
| D...T | F.....SN..PL.K.T.. | ..HG.....NF......T | ...DDR | ........... | A..A........ | 0.01 | 1 |
| ..... | F................. | .K.T.....DF....... | E..ND. | ...TG..T..GQ | A..A........ | 0.01 | 1 |
| ..... | ................. | ................. | R..DD. | .DTRAD..EF.D | A..A........ | 0.01 | 1 |
| .A... | F.....DRG.S...T.A.S | ................. | G..N.. | ........... | A..A........ | 0.01 | 1 |
| RA... | F......TG..Q.T.T.G | ................. | G..DG | ........... | ........... | 0.01 | 1 |
| AT... | F.....ASA.S..T.T.G | .QPG.....DF....... | ...DDR | ........... | ........... | 0.01 | 1 |
| RA... | ................. | ................. | ...DDR | ..AAGADTA.DD | A..A........ | 0.01 | 1 |
| ..... | F................. | .V........F....... | E..... | ........... | SHRA...ATV.H | 0.01 | 1 |
| ..... | F................. | .V........F....... | ...... | ........... | GPHNN..ADA.T | 0.01 | 1 |
| ..... | F................. | .V........F....... | ...... | ........... | TNRDA..ANT.T | 0.01 | 1 |
| ..... | ................. | ........NF....... | ...TD. | ........... | A..A........ | 0.01 | 1 |
| ..... | F................. | .V........F....... | ...... | ........... | GTRT...DRA.. | 0.01 | 1 |
| ..... | F.....NGG.NN.K.T.. | ................. | R..DD. | E.ARAN.IEVDQ | ........... | 0.01 | 1 |
| ..... | ................. | ........N......... | ...D.R | ...GGGDAA..G | A..A........ | 0.01 | 1 |
| ..... | ................. | ...............T | ...DDR | E..G.SDAA.GD | A..A........ | 0.01 | 1 |
| ..... | F.....GGG.NH...H.R | ..DGE....DF....... | ...... | ESAAASD..VGQ | A..A........ | 0.01 | 1 |
| GT... | F................. | .V........F....... | ...... | ........... | GRRDN..YRT.T | 0.01 | 1 |
| RA..T | ................. | ................. | R..KD. | ........... | A..A........ | 0.01 | 1 |
| AT... | ................. | ..HG.....NF......T | R..DG. | ........... | A..A........ | 0.01 | 1 |
| ..... | ................. | ................. | R..DD. | ........... | ...........D | 0.01 | 1 |
| NA... | F................. | .V........F....... | ...... | ........... | GTRST..FRE.T | 0.01 | 1 |
| RA... | ................. | TQP.R.....F....... | ...D.. | ........... | A..A........ | 0.01 | 1 |
| N.... | ................. | ................. | ...N.. | ........... | A..A........ | 0.01 | 1 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| RA... | ................. | .V........F....... | ...... | ............ | KDRNG...GK.D | 0.01 | 1 |
| SA... | F................. | .V........F....... | ...... | ............ | ............ | 0.01 | 1 |
| ..... | ................. | .........DF....... | ...DDR | .NG..A.I...G | A..A........ | 0.01 | 1 |
| ..... | ................. | ................. | ...... | ............ | TTSGP...QK.. | 0.01 | 1 |
| DT... | ................. | ................. | G..DG. | ............ | ............ | 0.01 | 1 |
| DT... | F......KT.NV.K.T.H | ................. | ...... | EDAG.AD.E.G. | A..A........ | 0.01 | 1 |
| T.... | ................. | ..PNG....DF....... | G..NDR | ............ | A..A........ | 0.01 | 1 |
| SA..T | F.....AR..L..P.D.K | .KYT.....NF......T | R...D. | E........... | A..A........ | 0.01 | 1 |
| GA... | F.....AA..IQ.T.K.R | .QAS......F....... | ...... | E.AARSD...GS | A..A........ | 0.01 | 1 |
| ..... | F.....SGA..V.T.G.G | .QPN......F......T | ...N.. | .D.GRAD.AF.S | A..A........ | 0.01 | 1 |
| EA... | F.....ATG.NV.T.G.R | .KDSR....DF....... | R...D. | .DAG.S.A..DR | A..A........ | 0.01 | 1 |
| ..... | F................. | .V........F....... | ...... | ............ | NEKDG...RG.Q | 0.01 | 1 |
| AA... | ................. | .........F......T | ...DDR | E..G.SDAA.GD | A..A........ | 0.01 | 1 |
| ..... | F.....ASA.S..T.T.G | .Q.DH....NF....... | ...DD. | ............ | A..A........ | 0.01 | 1 |
| GT... | F................. | ................. | ...... | E.TGRA..A..G | A..A........ | 0.01 | 1 |
| ..... | ................. | T.P......DF....... | ...D.. | .NTSTSD.E.DG | ............ | 0.01 | 1 |
| GT... | F.....NDG.NH.L.A.R | TKPS.....DF......T | ...DDR | ............ | A..A........ | 0.01 | 1 |
| A...T | ................. | TQASG....NF....... | ....D. | E.AS....IEYGQ | A..A........ | 0.01 | 1 |
| ST... | ................. | ................. | G..DG. | ............ | ............ | 0.01 | 1 |
| ..... | F................. | .V........F....... | ...... | ............ | GS.AR..SDV.E | 0.01 | 1 |
| ..... | ................R | .........F....... | ...... | ............ | A..A........ | 0.01 | 1 |
| ..... | F................. | .V........F....... | ...... | ............ | DSRTP...D..E | 0.01 | 1 |
| ..... | ................. | ................. | E..KG. | ............ | ............ | 0.01 | 1 |
| RA... | ................. | .QYGQ....DF......T | E..TGR | ...R.G.....E | A..A........ | 0.01 | 1 |
| T.... | F.....DDG.LA.K...R | ................. | ...... | ............ | ............ | 0.01 | 1 |
| ST... | ................. | ................. | ...DDR | ............ | ............ | 0.01 | 1 |
| ..... | F................. | .V.......F.. | ...... | ............ | TPHGS..FTM.. | 0.01 | 1 |
| ..... | F.....NQG..V.L.N.R | ..A......DF....... | ...DG. | EDAGGS.AEYD. | A..A........ | 0.01 | 1 |
| .A... | ................. | .........DF......T | ...... | E..G.A....DR | A..A........ | 0.01 | 1 |
| D...T | F................. | ................. | R..DD. | ............ | ............ | 0.01 | 1 |
| ..... | ................. | ................. | ...D.. | .DGA.....VGR | A..A........ | 0.01 | 1 |
| G.... | F.....AEG.LK.M.H.L | ..DGE....DF....... | ...... | ............ | A..A........ | 0.01 | 1 |
| SA..T | F......TG.IL...T.R | .QAS.....NF......T | ....GR | .DAGA.D.EVDE | ............ | 0.01 | 1 |
| T.... | ................. | .KDT......F......T | ...DD. | ESGA.A.AAV.G | A..A........ | 0.01 | 1 |
| ..... | ................. | ................. | R..DD. | E.TGAN.AE.GE | A..A........ | 0.01 | 1 |
| AA... | F.....AAT.N..P.P.R | ................T | ...DDR | ............ | ............ | 0.01 | 1 |

TABLE 7-continued

AAV capsid proteins having increased specificity for and/or transduction of CD44[+] GSC (pool of Round 1 selection). Amino acid numbers correspond to the amino acid sequence of VP1 (SEQ ID NO: 1). Sequences below correspond to SEQ ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| ..... | ................. | .QANH....DF....... | ...DDR | ............ | A..A........ | 0.01 | 1 |
| ..... | ................. | ................. | ...D.R | ..ARTADETE.DS | A..A....V... | 0.01 | 1 |
| ..... | ................. | T..SE....NF....... | ...D.R | E.GRGA..AV.E | A..A........ | 0.01 | 1 |
| N.... | F.....AEG.LK.M.H.L | ..DGE....DF....... | ...... | ............ | ............ | 0.01 | 1 |
| ..... | ..............T.T.R | ..YN......F......T | ...D.R | E.ATA...E.DD | A..A........ | 0.01 | 1 |
| ..... | F.....GQ..RV.T...L | ..A......DF....... | ...DG. | ............ | A..A........ | 0.01 | 1 |
| E.... | F.....DRG.SD.K.K.. | ..DNH....DF....... | ...ADR | ............ | A..A........ | 0.01 | 1 |
| ..... | F................. | ................. | ...DD. | ES.A...AAYGE | A..A..P..... | 0.01 | 1 |
| HT... | F......KT.NV.K.T.H | .V........F....... | ...... | ............ | A..A........ | 0.01 | 1 |
| G.... | ................. | ................. | R..DD. | .D.......... | A..A........ | 0.01 | 1 |
| A.... | ................. | ................. | G..T.R | ............ | A..A........ | 0.01 | 1 |
| G.... | ................. | TK.NE....NF....... | ...DDR | ............ | A..T........ | 0.01 | 1 |
| .A... | ................. | ................. | R..A.. | E.ATRA.IE.DD | A..A........ | 0.01 | 1 |
| TT..T | ................. | ..DGE....DF.R..... | ...... | ............ | ............ | 0.01 | 1 |
| ..... | ................. | ................. | ....G. | ..TG.D..A.GG | A..A........ | 0.01 | 1 |
| ..... | ................. | ................. | ...... | EDGRGD.TEVDQ | A..A........ | 0.01 | 1 |
| ..... | ................. | ...............T | ...DDR | ............ | A........... | 0.01 | 1 |
| SA..T | F................. | .V........F....... | ...... | ............ | GPRTP..FDI.A | 0.01 | 1 |
| GT... | F.....GSA.RP.N.H.K | ..DGE....DF....... | ....GR | ENAGASDIA.DH | ............ | 0.01 | 1 |
| EA... | F................. | .V........F....... | ...... | ............ | KRQAG...HE.A | 0.01 | 1 |
| TT... | F.....DRG.S..T.A.S | ..DGE....DF....... | ...... | ............ | ............ | 0.01 | 1 |
| ..... | F.....DA..IA.L.K.R | .KDSR............. | R..AG. | ESAG....A.GE | A..A........ | 0.01 | 1 |
| ..... | ................. | ................. | ...AD. | ESAG.DD.A.DQ | A..A........ | 0.01 | 1 |
| ..... | F......NG.PL.K...L | .V........F....... | ...... | ............ | A..A........ | 0.01 | 1 |
| ..... | ................. | ................. | ...... | .SARG..A..DE | A..A........ | 0.01 | 1 |
| G.... | ................. | ................. | ....GR | ..AG.N.AA.GQ | A..A........ | 0.01 | 1 |
| E.... | F................. | ................. | ....D. | .SAS.N.IA..D | A..A........ | 0.01 | 1 |
| ..... | F................. | .V........F....... | ...... | ............ | DR.SG..Y...H | 0.01 | 1 |
| NA... | F.....NKT.IV.T.E.R | TPPG.....DF....... | ...D.. | ............ | A..A........ | 0.01 | 1 |
| D...T | F.....SN..PL.K.T.. | ..HG.....NF......T | ...DD. | ESAGRS...VDR | A..A........ | 0.01 | 1 |
| ..... | F.....SKA.S..L.E.R | .QPG.....NF....... | G..AG. | ............ | A..A........ | 0.01 | 1 |
| .A... | ................. | .KYT.....NF......T | ...D.R | ESATGD..E.GQ | A..A........ | 0.01 | 1 |
| TA... | ................. | .QPG.....NF......T | ...D.. | ............ | A..A........ | 0.01 | 1 |
| .A... | F................. | ..........F....... | E..TD.. | ............ | ............ | 0.01 | 1 |
| ....T | F................. | .KYT.....NF......T | ...DDR | ............ | A..A........ | 0.01 | 1 |
| .A... | F.....NQA.SV...A.R | .........NF......T | ...DDR | E..G.SDAA.GD | A..A........ | 0.01 | 1 |

TABLE 7-continued

AAV capsid proteins having increased specificity for and/or transduction of
CD44⁺ GSC (pool of Round 1 selection). Amino acid numbers correspond to the
amino acid sequence of VP1 (SEQ ID NO: 1). Sequences below correspond to SEQ
ID NOs: 8 and 4706-6981 from top to bottom.

| 263 QSGAS | 444 YLSRTNTPSGTTTQSRLQ | 490 KTSADNNNSEYSWTGATK | 527 KKDEEK | 545 QGSEKTNVDIEK | 585 RGNRQAATADVN | % | # |
|---|---|---|---|---|---|---|---|
| EA... | F.....GGG....K.G.R | .KDT......F......T | ...DD. | ENGT.AD.AFDH | A..A........ | 0.01 | 1 |
| ..... | .................. | ..........F....... | G..AD. | ............ | A..A........ | 0.01 | 1 |
| .A... | .................. | .................. | E....R | ............ | A..A........ | 0.01 | 1 |
| ..... | .................. | ..........F....... | ...... | ............ | THRDA...EG.E | 0.01 | 1 |
| G.... | .................K | ..YN......F......T | ...D.R | .NGR.G..A..E | A..A........ | 0.01 | 1 |
| NA..T | F................. | .V........F....... | ...... | ............ | TRKNP..VS..E | 0.01 | 1 |
| ..... | .................. | .................. | ...D.. | ............ | ............ | 0.01 | 1 |
| T.... | .................. | .................. | G..DG. | ............ | ............ | 0.01 | 1 |
| GA... | F.....D....V.T.E.R | .................. | ...DD. | ............ | ............ | 0.01 | 1 |
| RA... | .................. | .................. | ...NDR | E.A.AD.AAF.. | A..A........ | 0.01 | 1 |
| ..... | .................. | ................T | G..D.R | ............ | A..A........ | 0.01 | 1 |
| ..... | .................. | .Q.D.....DF..P.... | ...A.. | ............ | ............ | 0.01 | 1 |
| A.... | .................. | .KYT.....NF....... | R...D. | ED.GGND.EV.D | A..A........ | 0.01 | 1 |
| .A... | .................. | .................. | R..DD. | EN.SAGD..... | A..A........ | 0.01 | 1 |
| ..... | .................. | .Q.DR....NF....... | G...D. | .SGS.N..AV.D | A..A........ | 0.01 | 1 |
| GA... | F......S..SA.I.K.K | .QHNH....DF....... | ...DD. | .NAGASDA.FDQ | A..A........ | 0.01 | 1 |
| ..... | .................. | .................. | R..DDE | ............ | ............ | 0.01 | 1 |
| G.... | .................. | TQP.R....NF......T | ...D.. | ............ | A..A........ | 0.01 | 1 |
| ..... | F................. | .................. | ...... | ............ | ............ | 0.01 | 1 |
| .A... | .................. | ................T | ....D. | E.TGRA..A..G | A..A........ | 0.01 | 1 |
| ..... | .................. | ..A......DF....... | ...DG. | EN.G.A.....Q | A..A........ | 0.01 | 1 |
| EA... | F.....DAA.IK.T.Q.N | .V........F....... | ...... | ............ | TT.D...DGV.A | 0.01 | 1 |
| ..... | .................. | .................. | RTMTTS | ............ | ............ | 0.01 | 1 |
| NA..T | .................. | .................. | ...... | ESGGAD.I...R | A..A....... | 0.01 | 1 |
| ..... | F.....GRT.S..L.G.R | .V........F....... | ...... | ES.AA..I.... | A..A........ | 0.01 | 1 |
| G...T | G.....GTG..P.T.D.R | ..AGQ....NF....... | ...DD. | E.AGTNDI...R | A..A........ | 0.01 | 1 |
| GA... | .................. | ..DGE...DF......T | ...N.. | ............ | A..A........ | 0.01 | 1 |
| ..... | .................. | T.PTG....DF....... | ...DDR | .DAG.A.I..DG | A..A........ | 0.01 | 1 |
| D.... | F.....NTG.LH.T...R | .................. | ...DG. | ............ | A..A........ | 0.01 | 1 |
| ..... | .................. | .................. | R...D. | E.AGRN.T..DD | A..A........ | 0.01 | 1 |
| NT... | F......GA.NM.T.A.R | .KDSR....DF......T | R..D.. | ..A.A.D.AFDS | A..A........ | 0.01 | 1 |
| ..... | .................. | .Q.G......F..P.... | ...... | ES.GEG...VDS | ............ | 0.01 | 1 |

TABLE 8

AAV capsid proteins having increased specificity for and/or transduction of CD44⁺ GSC (pool of Round 2 selection). Amino acid numbers correspond to the amino acid sequence of VP1 (SEQ ID NO: 1). Sequences below correspond to SEQ ID NOs: 8 and 6982-6986 from top to bottom.

| | 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN | % |
|---|---|---|---|---|---|---|---|
| # 65 | HA... | F.....GKG.ND.T.N.G | ..A......DF | ....... | ...DG. | ........... | ........... | 81.25 |
| 10 | GT... | F.....AEG.LK.M.H.L | ..DGE....DF | ...... | ...... | ........... | ........... | 12.50 |
| 2 | ..... | F.....ASA.S..T.T.G | .QPG.....DF | ....... | ...D.. | ........... | ........... | 2.50 |
| 2 | ST... | ................. | ..DGE....DF | ....... | R...D. | ........... | ........... | 2.50 |
| 1 | ..... | F.....SGT.NM.K.T.E | .Q.GQ....DF | ....... | ....G. | ........... | A..A........ | 1.25 |

Example 4

Validation of GBM-Specific Mutants

Figure 5:
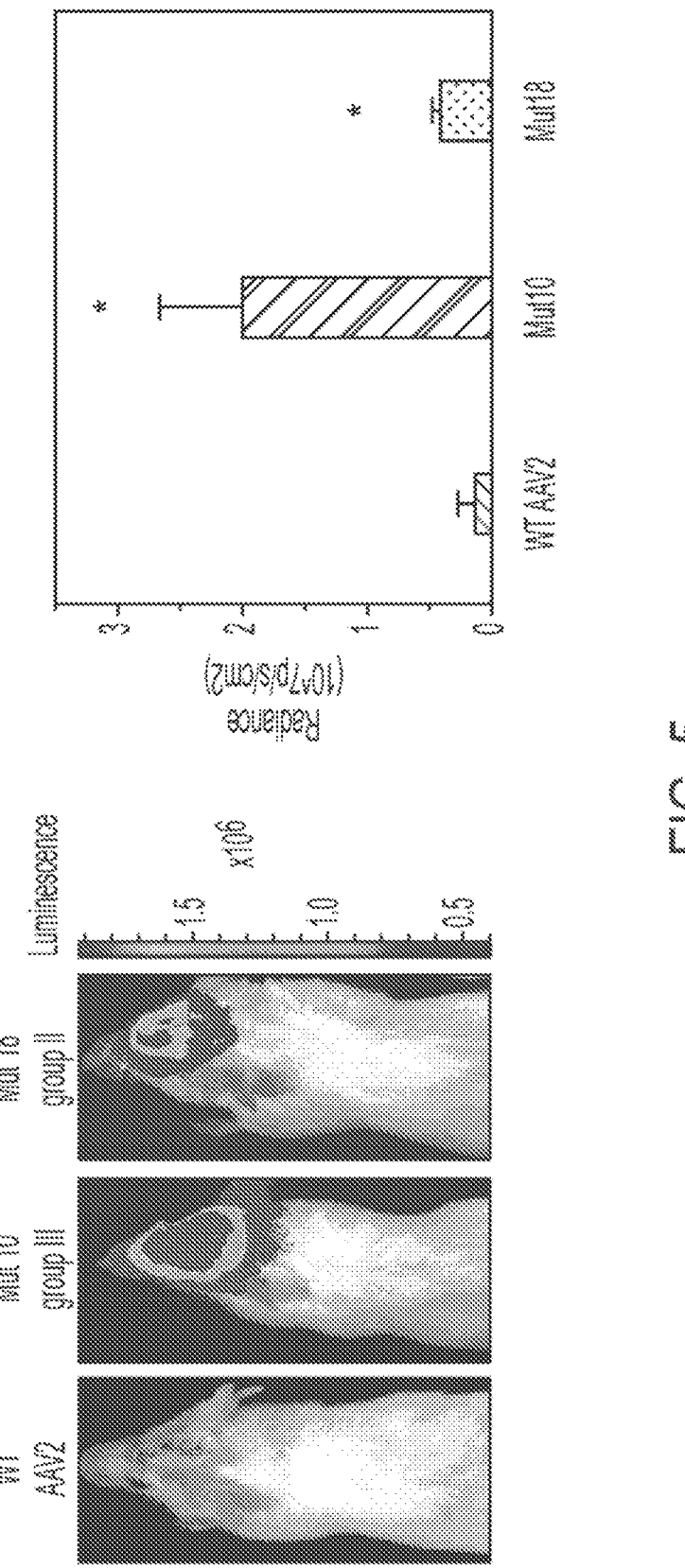
FIG. 5. Variants 10 and 18 exhibited greatly higher efficiency and specificity for GBM compared to WT AAV2, as measured by Antares BLI. *T-test $p\leq0.05$.

Variants (or mutants) numbered 1, 9, 19 and 23 (FIG. 4) and a control WT AAV2 were synthesized to express reporter gene Antares. An equal titer of mutants and two-fold higher titer of the WT was injected once into a cohort of D-luciferase-tagged glioblastoma multiforme (GBM) patient-derived xenograft (PDX) animals. Antares bioluminescence (using furimazine) was measured 4 days after injection. Antares bioluminescence was normalized against baseline D-luciferase bioluminescence (using D-luciferin). Results from Mutants 9 and 19, shown in (FIG. 5), were significantly elevated in efficiency and specificity for GBM compared to the unselected WT AAV2 control, as predicted by NGS analysis.

Figure 6A:
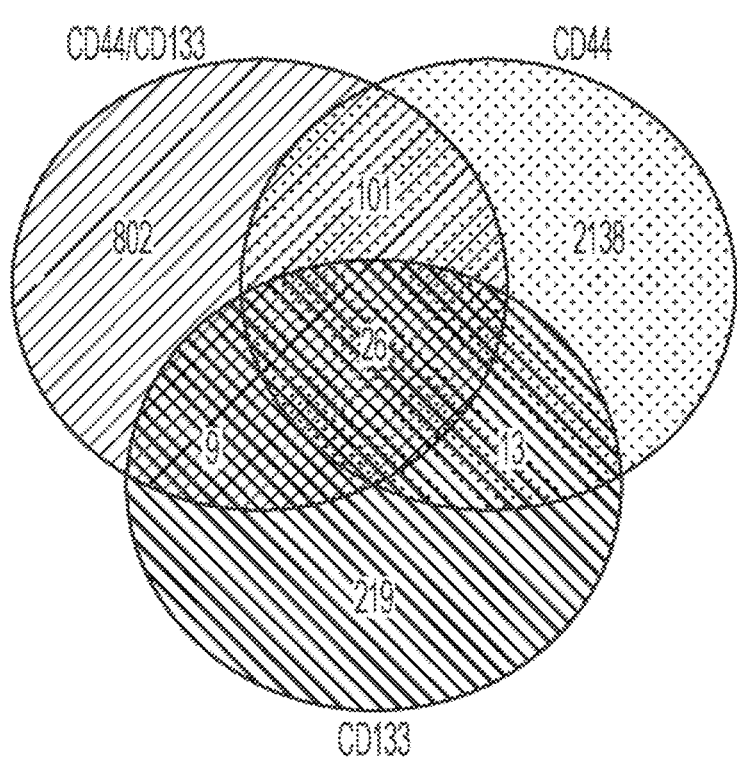
FIG. 6A. Overlapping of CD44+/133+, CD44+, CD133+ mutants after first round of selection.
Figure 6B:
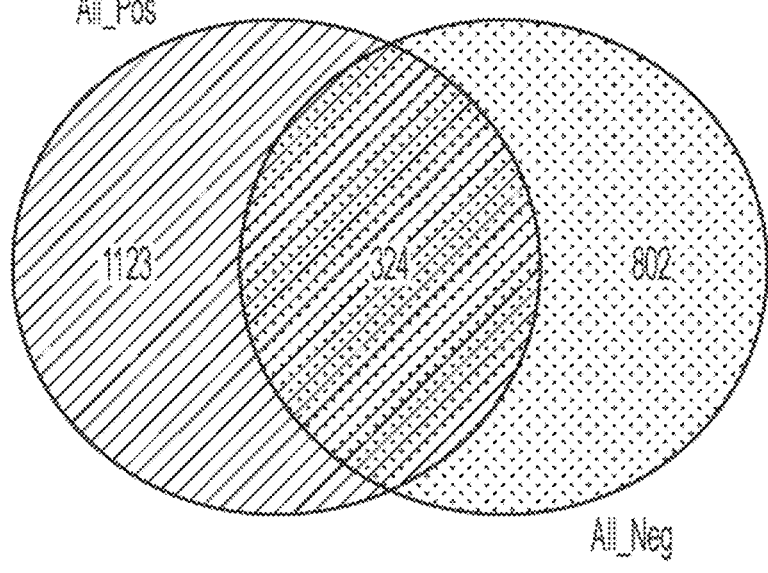
FIG. 6B. Overlapping of pooled library all-CD-positive (pooled library of DNA from CD44+/133+, CD44+, CD133+) and all-CD-negative (CD44−/133−).
Figure 7:
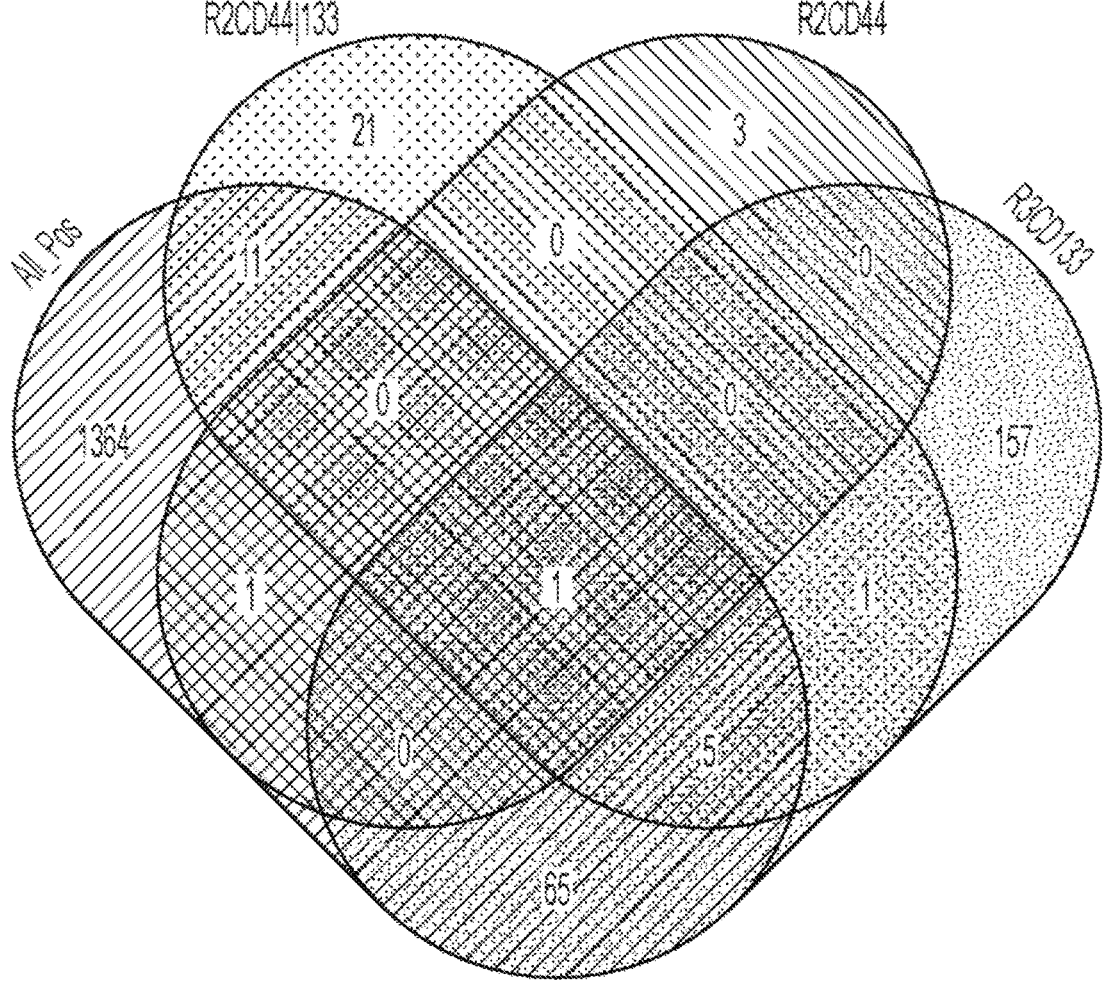
FIG. 7. Overlapping of pooled library all-CD-positive (injection mix) with mutants after 2nd round of selection: CD44+/133+, CD44+, CD133+.

As shown in FIGS. 6A, 6B, and 7, the pools of particular capsid variants that confer enhaned affinity for and transduction in cells following two rounds of selection from among different cell populations have significant overlap.

Several of the capsid variants conferring the highest transduction properties comprise substitutions at one of the following combinations of amino acid positions:

(a) Q263, 5264, Y444, T450, P451, 5452, T454, Q457, R459, Q461, 5492, A493, D494, E499, and Y500F, or (b) E531, K532, S547, E548, D553, R585, and R588 relative to SEQ ID NO: 1 (the AAV2 VP1 amino acid sequence).

TABLE 9

Variant Capsid Proteins: amino acid substitutions. Amino acid (AA) sequences of the top 23 capsid variants selected by three rounds of directed evolution targeting all four GSC and GBM cell populations. The numbers at the top of the list designate AA residue position within the WT AAV2 VP1 capsid sequence. The conserved, not mutated residues in the selected variants are identified by a dot, the positions of mutant AAs shown below the respective WT AAs. Variants with numbers 9, 10, 18, 19, and 23 are shown in bold. The frequency (in %) of the selected variants in NGS database are shown in four columns to the right of the sequences. In addition, variant designated '10*' was synthesized. Sequences below correspond to SEQ ID NOs: 8 and 6987-7010 from top to bottom.

| Variant | 263 QSGAS | 444 YLSRTNTPSGTTTQSRLQ | 490 KTSADNNNSEYSWTGATK | 527 KDDEEK | 545 QGSEKTNVDIEK | 585 RGNRQAATADVN |
|---|---|---|---|---|---|---|
| 1 | ..... | ................. | ................... | G..DG. | ........... | ........... |
| 2 | TA... | ................. | .QANH....DF....... | ...DDR | ........... | A..A........ |
| 3 | ..... | F................ | .V........F........ | ...... | ........... | A..A........ |
| 4 | ..... | ................. | ................... | ...N.. | ........... | A..A........ |
| 5 | ..... | F................ | .V........F........ | ...... | ........... | ........... |
| 6 | ..... | ................. | ................... | R..TG. | ........... | A..A........ |
| 7 | ..... | ................. | ................... | E..ND. | ........... | ........... |
| 8 | A.... | F.....DA..IA.L.K.R | .KDSR....DF......T | R..DD. | ........... | A..A........ |
| 9 (I) | ..... | ................. | ................... | ....GR | ..AG.N.AA.GQ | A..A........ |
| 10 (III) | .A... | F.....DRG.S..T.A.S | ..DGE....DF....... | ...... | ........... | ........... |
| 11 | RA... | F.....DTG.SK.T.T.R | .Q.S......F........ | ...D.. | .NGR.G..A..E | A..A........ |

TABLE 9-continued

Variant Capsid Proteins: amino acid substitutions. Amino acid (AA) sequences of
the top 23 capsid variants selected by three rounds of directed evolution targeting all four
GSC and GBM cell populations. The numbers at the top of the list designate AA residue
position within the WT AAV2 VP1 capsid sequence. The conserved, not mutated residues in
the selected variants are identified by a dot, the positions of mutant AAs shown below the
respective WT AAs. Variants with numbers 9, 10, 18, 19, and 23 are shown in bold. The
frequency (in %) of the selected variants in NGS database are shown in four columns to the
right of the sequences. In addition, variant designated '10*' was synthesized. Sequences
below correspond to SEQ ID NOs: 8 and 6987-7010 from top to bottom.

```
12          .....    ...................    .PPNG.....F......T    ...DDR    E.ATRA..A.DE    A..A........

13          .....    ...................    .QD.E.....F..P....    ...D..    ............    ............

14          .....    ...................    .Q.DR.....F.......    ....D.    ............    A..A........

15          .....    ...................    ...................    ......    ............    A..A........

16          .....    ...................    ...................    ...DDR    ...GT..AA.GD    A..A........

17          .....    ...................    ...................    ....D.    ............    A..A........

18 (II)     GT...    F.....AEG.LK.M.H.L     ..DGE....DF.......    ......    ............    ............

19          .....    ...................    ...................    ...NDR    ..AKG...AV..    A..A........

20          .....    ...................    ...................    R..AGR    ............    A..A........

21          .....    ...................    ...................    R..DD.    ............    A..A........

22          E....    F.....DRG.S..T.A.S     ..DGE....DF.......    ......    ............    ............

23 (IV)     E....    F.....ASA.S..T.T.G     .QPG.....DF.......    ...DDR    ............    ............

10*         AA...    F.....DRG.S..T.A.S     ..DGE....DF.......    ......    ............    ............
```

| | CD status | | | |
|---|---|---|---|---|
| Variant | 44+/133+ | 44-/133- | 44 + | 133+ |
| 1 | 0.31 | 0.80 | 0.30 | 0.43 |
| 2 | 0.45 | 0.55 | 0.59 | 0.07 |
| 3 | 0.10 | 0.16 | 0.30 | 0.14 |
| 4 | 0.08 | 0.16 | 0.45 | 0.62 |
| 5 | 0.29 | 0.23 | 0.74 | 1.01 |
| 6 | 0.02 | 0.09 | 0.18 | 0.57 |
| 7 | 0.05 | 0.23 | 0.07 | 0.09 |
| 8 | 0.27 | 0.34 | 0.25 | 0.56 |
| 9 (I) | 1.70 | 1.91 | 1.75 | 3.23 |
| 10 (III) | 0.88 | 0.88 | 0.29 | 0.56 |
| 11 | 0.14 | 0.15 | 0.02 | 0.43 |
| 12 | 0.43 | 0.26 | 0.21 | 0.07 |
| 13 | 0.35 | 0.16 | 0.32 | 0.51 |
| 14 | 0.13 | 0.04 | 0.01 | 0.30 |
| 15 | 0.46 | 0.65 | 0.76 | 0.46 |
| 16 | 0.15 | 0.08 | 0.13 | 0.61 |
| 17 | 0.02 | 0.19 | 0.15 | 0.95 |
| 18 (II) | 0.08 | 0.85 | 0.52 | 2.17 |
| 19 | 0.78 | 0.75 | 0.46 | 3.25 |
| 70 | 0.02 | 0.03 | 0.04 | 0.30 |

TABLE 9-continued

Variant Capsid Proteins: amino acid substitutions. Amino acid (AA) sequences of
the top 23 capsid variants selected by three rounds of directed evolution targeting all four
GSC and GBM cell populations. The numbers at the top of the list designate AA residue
position within the WT AAV2 VP1 capsid sequence. The conserved, not mutated residues in
the selected variants are identified by a dot, the positions of mutant AAs shown below the
respective WT AAs. Variants with numbers 9, 10, 18, 19, and 23 are shown in bold. The
frequency (in %) of the selected variants in NGS database are shown in four columns to the
right of the sequences. In addition, variant designated '10*' was synthesized. Sequences
below correspond to SEQ ID NOs: 8 and 6987-7010 from top to bottom.

| | | | |
|---|---|---|---|
| 21 | 0.29 | 0.47 | 0.13 | 0.33 |
| 22 | 0.02 | 0.01 | 0.01 | 0.53 |
| 23 (IV) | 0.92 | 1.15 | 1.47 | 0.95 |
| 10* | | | |

Full amino acid sequences for above variants #9, #10,
18, and #23 (indicated with boldface and Roman numerals
in the chart) are shown below.

Variant 9-
```
                              SEQ ID NO: 4
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNPSGTTTQSRLQFSQAGASDI

RDQSRNWLPGPCYRQQRVSKTSADNNNSEYSWTGATKYHLNGRDSLV

NPGPAMASHKDDEGRFFPQSGVLIFGKQGAGKNNAAIGQVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL
```

Variant 10-
```
                              SEQ ID NO: 5
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQAGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS
```

-continued
```
YAHSQSLDRLMNPLIDQYLYFLSRTNDRGGSTTTSALSFSQAGASDI

RDQSRNWLPGPCYRQQRVSKTDGENNNSDFSWTGATKYHLNGRDSLV

NPGPAMASHKDDEEKFFPQSGVLIFGKQGSEKTNVDIEKVMITDEEE

IRTTNPVATEQYGSVSTNLQRGNRQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL
```

Variant 18-
```
                              SEQ ID NO: 6
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSGTGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYFLSRTNAEGGLKTMSHLLFSQAGASDI

RDQSRNWLPGPCYRQQRVSKTDGENNNSDFSWTGATKYHLNGRDSLV

NPGPAMASHKDDEEKFFPQSGVLIFGKQGSEKTNVDIEKVMITDEEE

IRTTNPVATEQYGSVSTNLQRGNRQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL
```

Variant 23-
```
                              SEQ ID NO: 7
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG
```

-continued

```
KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSESGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYFLSRTNASAGSTTTSTLGFSQAGASDI

RDQSRNWLPGPCYRQQRVSKQPGDNNNSDFSWTGATKYHLNGRDSLV

NPGPAMASHKDDDDRFFPQSGVLIFGKQGSEKTNVDIEKVMITDEEE

IRTTNPVATEQYGSVSTNLQRGNRQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL
```

Full amino acid sequences for the remaining capsid variants in Table 9 are shown below.

Variant 1-

SEQ ID NO: 9
```
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKTSADNNNSEYSWTGATKYHLNGRDSLV

NPGPAMASHGDDDGKFFPQSGVLIFGKQGSEKTNVDIEKVMITDEEE

IRTTNPVATEQYGSVSTNLQRGNRQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL
```

Variant 2-

SEQ ID NO: 10
```
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSTAGASNDNHYFGYSTPWGYF

DFNRFHCHFSPRDWQRLINNNWGFRPKRLNFKLFNIQVKEVTQNDGT
```

-continued

```
TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKQANHNNNSDFSWTGATKYHLNGRDSLV

NPGPAMASHKDDDDRFFPQSGVLIFGKQGSEKTNVDIEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL
```

Variant 3-

SEQ ID NO: 11
```
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYFLSRTNTPSGTTTQSRLQFSQAGASDI

RDQSRNWLPGPCYRQQRVSKVSADNNNSEFSWTGATKYHLNGRDSLV

NPGPAMASHKDDEEKFFPQSGVLIFGKQGSEKTNVDIEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL
```

Variant 4-

SEQ ID NO: 12
```
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKTSADNNNSEYSWTGATKYHLNGRDSLV

NPGPAMASHKDDNEKFFPQSGVLIFGKQGSEKTNVDIEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS
```

TTFSAAKFASFITQYSTGQVSVEIEWELQKENSKRWNPEIQYTSNYN

KSVNVDFTVDTNGVYSEPRPIGTRYLTRNL

Variant 5-

SEQ ID NO: 13

MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYFLSRTNTPSGTTTQSRLQFSQAGASDI

RDQSRNWLPGPCYRQQRVSKVSADNNNSEFSWTGATKYHLNGRDSLV

NPGPAMASHKDDEEKFFPQSGVLIFGKQGSEKTNVDIEKVMITDEEE

IRTTNPVATEQYGSVSTNLQRGNRQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 6-

SEQ ID NO: 14

MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKTSADNNNSEYSWTGATKYHLNGRDSLV

NPGPAMASHRDDTGKFFPQSGVLIFGKQGSEKTNVDIEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 7-

SEQ ID NO: 15

MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKTSADNNNSEYSWTGATKYHLNGRDSLV

NPGPAMASHEDDNDKFFPQSGVLIFGKQGSEKTNVDIEKVMITDEEE

IRTTNPVATEQYGSVSTNLQRGNRQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 8-

SEQ ID NO: 16

MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSASGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYFLSRTNDASGIATLSKLRFSQAGASDI

RDQSRNWLPGPCYRQQRVSKKDSRNNNSDFSWTGATTYHLNGRDSLV

NPGPAMASHRDDDDKFFPQSGVLIFGKQGSEKTNVDIEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 11-

SEQ ID NO: 17

MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSRAGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYFLSRTNDTGGSKTTSTLRFSQAGASDI

-continued

RDQSRNWLPGPCYRQQRVSKQSSDNNNSEFSWTGATKYHLNGRDSLV

NPGPAMASHKDDDEKFFPQSGVLIFGKQNGRKGNVAIEEVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 12-

SEQ ID NO: 18

MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKPPNGNNNSEFSWTGATTYHLNGRDSLV

NPGPAMASHKDDDDRFFPQSGVLIFGKEGATRANVAIDEVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 13-

SEQ ID NO: 19

MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKQDAENNNSEFSWPGATKYHLNGRDSLV

NPGPAMASHKDDDEKFFPQSGVLIFGKQGSEKTNVDIEKVMITDEEE

IRTTNPVATEQYGSVSTNLQRGNRQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 14-

SEQ ID NO: 20

MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKQSDRNNNSEFSWTGATKYHLNGRDSLV

NPGPAMASHKDDDEDKFFPQSGVLIFGKQGSEKTNVDIEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 15-

SEQ ID NO: 21

MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKTSADNNNSEYSWTGATKYHLNGRDSLV

NPGPAMASHKDDEEKFFPQSGVLIFGKQGSEKTNVDIEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 16-

SEQ ID NO: 22

MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

-continued

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKTSADNNNSEYSWTGATKYHLNGRDSLV

NPGPAMASHKDDDDRFFPQSGVLIFGKQGSGTTNAAIGDVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 17-
                                        SEQ ID NO: 23
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKTSADNNNSEYSWTGATKYHLNGRDSLV

NPGPAMASHKDDEDKFFPQSGVLIFGKQGSEKTNVDIEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 19-
                                        SEQ ID NO: 24
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKTSADNNNSEYSWTGATKYHLNGRDSLV

NPGPAMASHKDDNDRFFPQSGVLIFGKQGAKGTNVAVEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 20-
                                        SEQ ID NO: 25
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKTSADNNNSEYSWTGATKYHLNGRDSLV

NPGPAMASHRDDAGRFFPQSGVLIFGKQGSEKTNVDIEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 21-
                                        SEQ ID NO: 26
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSQSGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYYLSRTNTPSGTTTQSRLQFSQAGASDI

RDQSRNWLPGPCYRQQRVSKTSADNNNSEYSWTGATKYHLNGRDSLV

NPGPAMASHRDDDDKFFPQSGVLIFGKQGSEKTNVDIEKVMITDEEE

IRTTNPVATEQYGSVSTNLQAGNAQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 22-
                                        SEQ ID NO: 27
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

-continued

```
HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSESGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYFLSRTNDRGGSTTTSALSFSQAGASDI

RDQSRNWLPGPCYRQQRVSKTDGENNNSDFSWTGATKYHLNGRDSLV

NPGPAMASHKDDEEKFFPQSGVLIFGKQGSEKTNVDIEKVMITDEEE

IRTTNPVATEQYGSVSTNLQRGNRQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL

Variant 10*-
                                        SEQ ID NO: 28
MAADGYLPDWLEDTLSEGIRQWWKLKPGPPPPKPAERHKDDSRGLVL

PGYKYLGPFNGLDKGEPVNEADAAALEHDKAYDRQLDSGDNPYLKYN

HADAEFQERLKEDTSFGGNLGRAVFQAKKRVLEPLGLVEEPVKTAPG

KKRPVEHSPVEPDSSSGTGKAGQQPARKRLNFGQTGDADSVPDPQPL

GQPPAAPSGLGTNTMATGSGAPMADNNEGADGVGNSSGNWHCDSTWM

GDRVITTSTRTWALPTYNNHLYKQISSAAGASNDNHYFGYSTPWGYF

DFNRFHCHFSPRDWQRLINNNWGFRPKRLNFKLFNIQVKEVTQNDGT

TTIANNLTSTVQVFTDSEYQLPYVLGSAHQGCLPPFPADVFMVPQYG

YLTLNNGSQAVGRSSFYCLEYFPSQMLRTGNNFTFSYTFEDVPFHSS

YAHSQSLDRLMNPLIDQYLYFLSRTNDRGGSTTTSALSFSQAGASDI

RDQSRNWLPGPCYRQQRVSKTDGENNNSDFSWTGATKYHLNGRDSLV

NPGPAMASHKDDEEKFFPQSGVLIFGKQGSEKTNVDIEKVMITDEEE

IRTTNPVATEQYGSVSTNLQRGNRQAATADVNTQGVLPGMVWQDRDV

YLQGPIWAKIPHTDGHFHPSPLMGGFGLKHPPPQILIKNTPVPANPS

TTFSAAKFASFITQYSTGQVSVEIEWELQKENSKRWNPEIQYTSNYN

KSVNVDFTVDTNGVYSEPRPIGTRYLTRNL
```

Example 5

Validation of Capsid Variants In Vitro

The directed evolution screen identified capsid variants #9, #10, #18, and #23 as four of the best-transducing capsids in GBM and GSC cells. Recombinant AAV particles comprising these capsids were evaluated in vitro in patient-derived cells in 3D perfused neurosphere assays (FIG. 8A). A neurosphere is a culture system composed of free-floating clusters of cells. As used herein, the Neurosphere Assay (NSA) involves patient-derived GBM and GSC cells cultured in defined serum-free conditions. NSA permits a model reflective of in vivo tumorigenic potential and growth in the use of clonal spheres of cells. The polyacrylamide neurosphere assay (pNSA) involves the use of 10-20 μm microgels composed of transparent polyacrylamide hydrogel particles immersed in an aqueous solution of polyethylene glycol (PEG) (FIG. 8B). AAV perfusion, or dynamic passage, is shown. As used herein, the pNSA assay indicates support in patient-derived GBM clonal spheres and enables in situ fluorescence acquisition at the resolution of a single cell.

AAV particles comprising each of these four capsids were engineered to express the Antares gene. Particles were administered to GBM cells and GSC cells, and fluorescence (mFI) was evaluated on days 1, 3, and 5 post-transduction. As shown in FIGS. 8C-8D, the kinetics and tropism of transduction in serum-free GBM cells of were favorable. The transduction kinetics for particles comprising capsid variant #9 in particular were excellent, as shown in FIG. 8C. A ranking of transduction kinetics as of day 5 for these four variants is shown in FIG. 8D. Mutant #9 is indicated at the bar furthest to the right. The efficient transduction of these capsids in a serum-free perfusion suggests that these particles may be suitable for scalable rAAV production and confirm the directed evolution screen and the in vivo validation experiment shown in Example 4.

AAV particles comprising each of these four capsids were engineered to express GFP with or without one of three short hairpin RNAs (shRNA): a scrambled shRNA, an shRNA targeting the Nkx6-2 and Ascl-1 genes for knockdown, or an shRNA targeting Nkx6-2 alone. Particles were expression of GFP (i.e., measuring AAV transduction), sphere size, and propidium iodide (PI) uptake (a measure of cell death). As shown in FIGS. 9A-9C, particles containing capsid variant #9 carrying either shRNA targeting Nkx6-2 or the Nkx6-2/Ascl1 combination effectively transduced GBM and GSC and silenced both Nkx6-2 and Ascl-1 expression leading to reduction of GBM sphere size and increase in cell death as compared to the control scrambled shRNA containing AAV, as determined in a pNSA assay. Compared to scrambled shRNA (the control, X), cell survival is substantially reduced in Nkx6-2/Ascl-1 (Y) and Nkx6-2 (Z) short hairpin RNA over days 4-8 post-transduction (FIGS. 9B-9C). Size reduction and increased death was mediated by shRNA depletion of MR, as captured by PI uptake using an expert confocal algorithm. The chart in FIG. 9C shows the differential kinetics of cell killing (survival %) for particles expressing the three shRNA cassettes. Nkx6-2/Ascl-1 shRNA-expressing vectors caused the most cell death, while Nkx6-2 (alone) vectors caused the most dramatic single-day increase in cell death (between days 7 and 8). These kinetics enabled further screening of these four lead AAV variants.

Other Embodiments

All of the features disclosed in this specification may be combined in any combination. Each feature disclosed in this specification may be replaced by an alternative feature serving the same, equivalent, or similar purpose. Thus, unless expressly stated otherwise, each feature disclosed is only an example of a generic series of equivalent or similar features.

From the above description, one skilled in the art can easily ascertain the essential characteristics of the present disclosure, and without departing from the spirit and scope thereof, can make various changes and modifications of the disclosure to adapt it to various usages and conditions. Thus, other embodiments are also within the claims.

Equivalents

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

All definitions, as defined and used herein, should be understood to control over dictionary definitions, definitions in documents incorporated by reference, and/or ordinary meanings of the defined terms.

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in one embodiment, to A only (optionally including elements other than B); in another embodiment, to B only (optionally including elements other than A); in yet another embodiment, to both A and B (optionally including other elements); etc.

As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e., "one or the other but not both") when preceded by terms of exclusivity, such as "either," "one of," "only one of," or "exactly one of." "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in one embodiment, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc.

It should also be understood that, unless clearly indicated to the contrary, in any methods claimed herein that include more than one step or act, the order of the steps or acts of the method is not necessarily limited to the order in which the steps or acts of the method are recited.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03. It should be appreciated that embodiments described in this document using an open-ended transitional phrase (e.g., "comprising") are also contemplated, in alternative embodiments, as "consisting of" and "consisting essentially of" the feature described by the open-ended transitional phrase. For example, if the disclosure describes "a composition comprising A and B", the disclosure also contemplates the alternative embodiments "a composition consisting of A and B" and "a composition consisting essentially of A and B".

SEQUENCE LISTING (7010 sequences)

SEQ ID NO: 1 - protein, 735 aa, adeno-associated virus 2
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 2 - protein, 598 aa, adeno-associated virus 2
MAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 3 - protein, 533 aa, adeno-associated virus 2
MATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 4 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 5 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 6 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSGTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 7 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 8 - protein, 334 aa, adeno-associated virus 2
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 9 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 10 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSTAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 11 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 12 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSEKTNVDIEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 13 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 14 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGKFFPQSGVLIFGKQGSEKTNVDIEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 15 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 16 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKDSRNNNSDFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 17 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSRAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQSSDNNNSEFSWTGATKYHLNGRDSLVNPGPAMASHKDDDEKFFPQSGVLIFGKQNGRKGNVAIEEVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 18 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGATRANVAIDEVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 19 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDAENNNSEFSWPGATKYHLNGRDSLVNPGPAMASHKDDDEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 20 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 21 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 22 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSGTTNAAIGDVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 23 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 24 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGAKGTNVAVEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 25 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAGRFFPQSGVLIFGKQGSEKTNVDIEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 26 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQAGNAQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 27 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 28 - protein, 735 aa, Artificial Sequence
  Synthetic
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSAAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 29 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGAKGTNVAVEKVMITDEEEIRTTNPVATEQYGSVSTNLQAGNAQAATADVN

SEQ ID NO: 30 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 31 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 32 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARRDEAAANTVH

SEQ ID NO: 33 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHKDDADKFFPQSGVLIFGKEDGGGSNVEYGSVMITDEEEIRTTNPVATEQYGSVSTNLQAGNAQAATADVN

SEQ ID NO: 34 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGKFFPQSGVLIFGKQGSEKTNVDIEKVMITDEEEIRTTNPVATEQYGSVSTNLQAGNAQAATADVN

SEQ ID NO: 35 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKEGARETNVEIDQVMITDEEEIRTTNPVATEQYGSVSTNLQAGNAQAATADVN

SEQ ID NO: 36 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGIMTTSTLRFSQAGASDIRDQSRNWLPGPCYRQQRVSKVSADNNNSEFSWTGATKYHLNGRDSLVNPGPAMASHKDDEEKFFPQSGVLIFGKQGSKANDTEYESVMITDEEEIRTTNPVATEQYGSVSTNLQAGNAQAATADVN

SEQ ID NO: 37 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQATSDHAANRDVA

SEQ ID NO: 38 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSNENNNSDFSWTGATTYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 39 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 40 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQGGIATQSRLKFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 41 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGHKTTSNLGFSQAGASDIRDQSRNWLPGPCYRQQRVSKTHGDNNNSNFSWTGATTYHLNGRDSLVNPGPAMASHEDDNEKFFPQSGVLIFGKEGSEKTNVDIEKVMITDEEEIRTTNPVATEQYGSVSTNLQAGNAQAATADVN

SEQ ID NO: 42 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGAKATDTEVEQVMITDEEEIRTTNPVATEQYGSVSTNLQAGNAQAATADVN

SEQ ID NO: 43 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 44 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 45 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQNATGTNVDVGSVMITDEEEIRTTNPVATEQYGSVSTNLQAGNAQAATADVN

SEQ ID NO: 46 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKESSGTTNVAIDGVMITDEEEIRTTNPVATEQYGSVSTNLQAGNAQAATADVN

SEQ ID NO: 47 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPDGNNNSNFSWTGATKYHLNGRDSLVNPGPAMASHKDDEDRFFPQSGVLIFGKQGSEKTNVDIEKVMITDEEEIRTTNPVATEQYGSVSTNLQAGNAQAATADVN

SEQ ID NO: 48 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 49 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDDERFFPQSGVLIFGKQDSTRTNAAIEQVMITDEEEIRTTNPVATEQYGSVSTNLQAGNAQAATADVN

SEQ ID NO: 50 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKEDGATGNVDVDRVMITDEEEIRTTNPVATEQYGSVSTNLQAGNAQAATADVN

SEQ ID NO: 51 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHMTMSSLMFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 52 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTNSTLRFSQAGASDIRDQSRNWLPGPCYRQQRVSKQHNQNNNSEFSWTGATTYHLNGRDSLVNPGPAMASHKDDNEKFFPQSGVLIFGKEGAAKSDVAVGGVMITDEEEIRTTNPVATEQYGSVSTNLQAGNAQAATADVN

SEQ ID NO: 53 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEDGNTNNADVDSVMITDEEEIRTTNPVATEQYGSVSTNLQAGNAQAATADVN

SEQ ID NO: 54 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAGKTNIAYGNVMITDEEEIRTTNPVATEQYGSVSTNLQAGNAQAATADVN

SEQ ID NO: 55 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTSKATAAFREVT

SEQ ID NO: 56 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSTLNFSQAGASDIRDQSRNWLPGPCYRQQRVSKTSADNNNSEYSWTGATKYHLNGRDSLVNPGPAMASHKDDEEKFFPQSGVLIFGKQGTGKDNVAIGGVMITDEEEIRTTNPVATEQYGSVSTNLQAGNAQAATADVN

SEQ ID NO: 57 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPGGTQTNSRLRFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 58 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKENAAGNDVAVDRVMITDEEEIRTTNPVATEQYGSVSTNLQAGNAQAATADVN

SEQ ID NO: 59 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGASETNVEIDKVMITDEEEIRTTNPVATEQYGSVSTNLQAGNAQAATADVN

SEQ ID NO: 60 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 61 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKTKNPAATGEVH

SEQ ID NO: 62 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHGDDDDKFFPQSGVLIFGKQGSEKTNVDIEKVMITDEEEIRTTNPVATEQYGSVSTNLQAGNAQAATADVN

SEQ ID NO: 63 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNNTISSLGFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 64 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGITTTSALKFSQAGASDIRDQSRNWLPGPCYRQQRVSKTDGENNNSDFSWTGATKYHLNGRDSLVNPGPAMASHKDDEEKFFPQSGVLIFGKEGAGKSNVEIDNVMITDEEEIRTTNPVATEQYGSVSTNLQAGNAQAATADVN

SEQ ID NO: 65 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDAGRNNIAIDGVMITDEEEIRTTNPVATEQYGSVSTNLQAGNAQAATADVN

SEQ ID NO: 66 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGPTTQSKLQFSQAGASDIRDQSRNWLPGPCYRQQRVSKTSADNNNSNFSWTGATKYHLNGRDSLVNPGPAMASHRDDEDKFFPQSGVLIFGKQDGKGNDVDIDGVMITDEEEIRTTNPVATEQYGSVSTNLQAGNAQAATADVN

SEQ ID NO: 67 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQDAGKSNADIDRVMITDEEEIRTTNPVATEQYGSVSTNLQAGNAQAATADVN

SEQ ID NO: 68 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPDNRNNTSDFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 69 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGGATGNVDVDKVMITDEEEIRTTNPVATEQYGSVSTNLQAGNAQAATADVN

SEQ ID NO: 70 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGSTTTSKLKFSQAGASDIRDQSRNWLPGPCYRQQRVSKTDDDNNNSDFSWTGATKYHLNGRDSLVNPGPAMASHKDDEDKFFPQSGVLIFGKESTDRGNADIGEVMITDEEEIRTTNPVATEQYGSVSTNLQAGNAQAATADVN

SEQ ID NO: 71 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRSGTVTNSHLEFSQAGASDIRDQSRNWLPGPCYRQQRVSTTPADNNNSDFSWTGATKYHLNGRDSLVNPGPAMASHKDDDEKFFPQSGVLIFGKQGSGKSNVAFGDVMITDEEEIRTTNPVATEQYGSVSTNLQAGNAQAATADVN

SEQ ID NO: 72 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSAHNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 73 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 74 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNESGSDTHSRLKFSQAGASDIRDQSRNWLPGPCYRQQRVSKQSDRNNNSEFSWTGATKYHLNGRDSLVNPGPAMASHKDDEDKFFPQSGVLIFGKQNAGKDDVDIDQVMITDEEEIRTTNPVATEQYGSVSTNLQAGNAQAATADVN

SEQ ID NO: 75 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSGTTNAAIGDVMITDEEEIRTTNPVATEQYGSVSTNLQAGNAQAATADVN

SEQ ID NO: 76 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDNEKFFPQSGVLIFGKQSASKNNIAIEEVMITDEEEIRTTNPVATEQYGSVSTNLQAGNAQAATADVN

SEQ ID NO: 77 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHRDDDDRFFPQSGVLIFGKQSARTGDTAIEGVMITDEEEIRTTNPVATEQYGSVSTNLQAGNAQAATADVN

SEQ ID NO: 78 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 79 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWPGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 80 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSMTMSTLKFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 81 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDTDNNNSDFSWTGATKYHLNGRDSLVNPGPAMASHKDDNEKFFPQSGVLIFGKEGSERSNVDFEQVMITDEEEIRTTNPVATEQYGSVSTNLQAGNAQAATADVN

SEQ ID NO: 82 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTTHGRNNNSNFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 83 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTSRGGAAITDVQ

SEQ ID NO: 84 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHRDDDGKFFPQSGVLIFGKQSGGRSNVEIDQVMITDEEEIRTTNPVATEQYGSVSTNLQAGNAQAATADVN

SEQ ID NO: 85 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPARNNNSNFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 86 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGKFFPQSGVLIFGKQGSEKTNVDIEKVMITDEEEIRTTNPVATEQYGSVSTNLQAGNAQAATADVN

SEQ ID NO: 87 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSNFSWTGATKYHLNGRDSLVNPGPAMASHKDDDDRFFPQSGVLIFGKEDSRGSNVEVGQVMITDEEEIRTTNPVATEQYGSVSTNLQAGNAQAATADVN

SEQ ID NO: 88 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSITMSGLRFSQAGASDIRDQSRNWLPGPCYRQQRVSKKDSRNNNSDFSWTGATKYHLNGRDSLVNPGPAMASHEDDNDKFFPQSGVLIFGKESARKTDAAIDDVMITDEEEIRTTNPVATEQYGSVSTNLQAGNAQAATADVN

SEQ ID NO: 89 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGPNTNSNLKFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 90 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNTKNGAANGSVN

SEQ ID NO: 91 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGRTTMSGLRFSQAGASDIRDQSRNWLPGPCYRQQRVSKTSADNNNSEYSWTGATKYHLNGRDSLVNPGPAMASHKDDEEKFFPQSGVLIFGKEGAGTADIEVDKVMITDEEEIRTTNPVATEQYGSVSTNLQAGNAQAATADVN

SEQ ID NO: 92 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGGARTDVEIGEVMITDEEEIRTTNPVATEQYGSVSTNLQAGNAQAATADVN

SEQ ID NO: 93 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQGAGTTDVEYGQVMITDEEEIRTTNPVATEQYGSVSTNLQAGNAQAATADVN

SEQ ID NO: 94 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 95 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSTQDSDNNNSNFSWTGATTYHLNGRDSLVNPGPAMASHKDDEEKFFPQSGVLIFGKEGTGRANVAIEGVMITDEEEIRTTNPVATEQYGSVSTNLQAGNAQAATADVN

SEQ ID NO: 96 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKDSRNNNSDFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 97 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAERFFPQSGVLIFGKQGANGNDVAIEHVMITDEEEIRTTNPVATEQYGSVSTNLQAGNAQAATADVN

SEQ ID NO: 98 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 99 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 100 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKESARRDNADIDGVMITDEEEIRTTNPVATEQYGSVSTNLQAGNAQAATADVN

SEQ ID NO: 101 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 102 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGPITKSQLKFSQAGASDIRDQSRNWLPGPCYRQQRVSKKDSRNNNSDFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 103 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGHTTLSSLLFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 104 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKEDATENNIDIDRVMITDEEEIRTTNPVATEQYGSVSTNLQAGNAQAATADVN

SEQ ID NO: 105 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDAENNNSEFSWPGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 106 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSGDNNNSDFSWTGATKYHLNGRDSLVNPGPAMASHKDDDDRFFPQSGVLIFGKQDSRKTNVAFDGVMITDEEEIRTTNPVATEQYGSVSTNLQAGNAQAATADVN

SEQ ID NO: 107 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHGDDKEKFFPQSGVLIFGKEGSGKSDVAFEGVMITDEEEIRTTNPVATEQYGSVSTNLQAGNAQAATADVN

SEQ ID NO: 108 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDEEKFFPQSGVLIFGKEGAGKTNIAVDRVMITDEEEIRTTNPVATEQYGSVSTNLQAGNAQAATADVN

SEQ ID NO: 109 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSKRANTEIGEVMITDEEEIRTTNPVATEQYGSVSTNLQAGNAQAATADVN

SEQ ID NO: 110 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPSSGAATNKVQ

SEQ ID NO: 111 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGSNTMSRLKFSQAGASDIRDQSRNWLPGPCYRQQRVSKTSADNNNSNFSWTGATTYHLNGRDSLVNPGPAMASHRDDAGKFFPQSGVLIFGKQGGTKDDVDIDNVMITDEEEIRTTNPVATEQYGSVSTNLQAGNAQAATADVN

SEQ ID NO: 112 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTDGENNNSDFSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 113 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDEDRFFPQSGVLIFGKQSAGANNVEIESVMITDEEEIRTTNPVATEQYGSVSTNLQAGNAQAATADVN

SEQ ID NO: 114 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATTYHLNGRDSLVNPGPAMASHEDDKDKFFPQSGVLIFGKQGSEKTNVDIEKVMITDEEEIRTTNPVATEQYGSVSTNLQRGNRQAATADVN

SEQ ID NO: 115 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 116 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDSTGNNIDIEQVMITDEEEIRTTNPVATEQYGSVSTNLQAGNAQAATADVN

SEQ ID NO: 117 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDEDKFFPQSGVLIFGKEGGATGNVDVDKVMITDEEEIRTTNPVATEQYGSVSTNLQAGNAQAATADVN

SEQ ID NO: 118 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 119 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGNMTTSALRFSQAGASDIRDQSRNWLPGPCYRQQRVSKQPTRNNNSDFSWTGATKYHLNGRDSLVNPGPAMASHEDDNGKFFPQSGVLIFGKQDAGKSNADIEEVMITDEEEIRTTNPVATEQYGSVSTNLQAGNAQAATADVN

SEQ ID NO: 120 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGKGQAASGDVE

SEQ ID NO: 121 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDAGKFFPQSGVLIFGKEGSDRSNVEFDNVMITDEEEIRTTNPVATEQYGSVSTNLQAGNAQAATADVN

SEQ ID NO: 122 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTLSNLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 123 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKTYNDNNNSEFSWTGATTYHLNGRDSLVNPGPAMASHKDDDERFFPQSGVLIFGKEGSRKNNAEFGEVMITDEEEIRTTNPVATEQYGSVSTNLQAGNAQAATADVN

SEQ ID NO: 124 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 125 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQSSDNNNSEFSWTGATKYHLNGRDSLVNPGPAMASHKDDDEKFFPQSGVLIFGKQNGRKGNVAIEEVMITDEEEIRTTNPVATEQYGSVSTNLQAGNAQAATADVN

SEQ ID NO: 126 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATMSKLRFSQAGASDIRDQSRNWLPGPCYRQQRVSTTPTGNNNSDFSWTGATKYHLNGRDSLVNPGPAMASHKDDDDRFFPQSGVLIFGKQNAGKADVAVEQVMITDEEEIRTTNPVATEQYGSVSTNLQAGNAQAATADVN

SEQ ID NO: 127 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKEGSAKANVDIGEVMITDEEEIRTTNPVATEQYGSVSTNLQAGNAQAATADVN

SEQ ID NO: 128 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 129 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKAGSTTLSELRFSQAGASDIRDQSRNWLPGPCYRQQRVSKQSSDNNNSEFSWTGATKYHLNGRDSLVNPGPAMASHRDDEEKFFPQSGVLIFGKEGGTEGDADIDKVMITDEEEIRTTNPVATEQYGSVSTNLQAGNAQAATADVN

SEQ ID NO: 130 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSDFSWTGATNYHLNGRDSLVNPGPAMASHRDDAGRFFPQSGVLIFGKEGATATDTAVEDVMITDEEEIRTTNPVATEQYGSVSTNLQAGNAQAATADVN

SEQ ID NO: 131 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTAHSAAAITVVN

SEQ ID NO: 132 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGTEKSNVAIERVMITDEEEIRTTNPVATEQYGSVSTNLQAGNAQAATADVN

SEQ ID NO: 133 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNVTISQLGFSQAGASDIRDQSRNWLPGPCYRQQRVSKQSDHNNNSNFSWTGATKYHLNGRDSLVNPGPAMASHKDDDDKFFPQSGVLIFGKQGTKKTNAEIEDVMITDEEEIRTTNPVATEQYGSVSTNLQAGNAQAATADVN

SEQ ID NO: 134 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGTGIVTKSGLKFSQAGASDIRDQSRNWLPGPCYRQQRVSKTSADNNNSEYSWTGATKYHLNGRDSLVNPGPAMASHKDDEEKFFPQSGVLIFGKQGARGADAEIESVMITDEEEIRTTNPVATEQYGSVSTNLQAGNAQAATADVN

SEQ ID NO: 135 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPDQNNNSEFSWTGATKYHLNGRDSLVNPGPAMASHGDDNDKFFPQSGVLIFGKQGTGASNVEVENVMITDEEEIRTTNPVATEQYGSVSTNLQAGNAQAATADVN

SEQ ID NO: 136 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGRSNAAFDVVQ

SEQ ID NO: 137 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRTGTMTKSALSFSQAGASDIRDQSRNWLPGPCYRQQRVSKQSDRNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 138 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGLQTLSDLRFSQAGASDIRDQSRNWLPGPCYRQQRVSKKYTDNNNSNFSWTGATTYHLNGRDSLVNPGPAMASHKDDDDKFFPQSGVLIFGKEGAKKNNVAVDGVMITDEEEIRTTNPVATEQYGSVSTNLQAGNAQAATADVN

SEQ ID NO: 139 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTKTNSSLSFSQAGASDIRDQSRNWLPGPCYRQQRVSKTHGDNNNSNFSWTGATTYHLNGRDSLVNPGPAMASHKDDDEKFFPQSGVLIFGKQGADRSNVDVGSVMITDEEEIRTTNPVATEQYGSVSTNLQAGNAQAATADVN

SEQ ID NO: 140 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDAGRNNIAIDGVMITDEEEIRTTNPVATEQYGSVSTNLQAGNAQAATADVN

SEQ ID NO: 141 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKQDTGADNIAVENVMITDEEEIRTTNPVATEQYGSVSTNLQAGNAQAATADVN

SEQ ID NO: 142 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGTSGNQTKSGLRFSQAGASDIRDQSRNWLPGPCYRQQRVSKKPDQNNNSEFSWTGATKYHLNGRDSLVNPGPAMASHKDDDDRFFPQSGVLIFGKQGAEKADVEIGGVMITDEEEIRTTNPVATEQYGSVSTNLQAGNAQAATADVN

SEQ ID NO: 143 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGRNTTSTLLFSQAGASDIRDQSRNWLPGPCYRQQRVSKTSADNNNSNFSWTGATKYHLNGRDSLVNPGPAMASHRDDEDKFFPQSGVLIFGKESSGRGDVDIDRVMITDEEEIRTTNPVATEQYGSVSTNLQAGNAQAATADVN

SEQ ID NO: 144 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHVTQSRLLFSQAGASDIRDQSRNWLPGPCYRQQRVSKTHGDNNNSNFSWTGATTYHLNGRDSLVNPGPAMASHKDDDEKFFPQSGVLIFGKEGSGASDVAIEQVMITDEEEIRTTNPVATEQYGSVSTNLQAGNAQAATADVN

SEQ ID NO: 145 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKQSADNNNSDFSWTGATKYHLNGRDSLVNPGPAMASHKDDEEKFFPQSGVLIFGKQNSAAGNVEIGDVMITDEEEIRTTNPVATEQYGSVSTNLQAGNAQAATADVN

SEQ ID NO: 146 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 147 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRSGSLTHSDLRFSQAGASDIRDQSRNWLPGPCYRQQRVSKTDAENNNSDFSWTGATKYHLNGRDSLVNPGPAMASHKDDDDKFFPQSGVLIFGKEGGRKDDVEIGEVMITDEEEIRTTNPVATEQYGSVSTNLQAGNAQAATADVN

SEQ ID NO: 148 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKEGTEKSNVAIERVMITDEEEIRTTNPVATEQYGSVSTNLQAGNAQAATADVN

SEQ ID NO: 149 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENTDASNADIENVMITDEEEIRTTNPVATEQYGSVSTNLQAGNAQAATADVN

SEQ ID NO: 150 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGASETNAAYDSVMITDEEEIRTTNPVATEQYGSVSTNLQAGNAQAATADVN

SEQ ID NO: 151 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRQNGAAAPTVN

SEQ ID NO: 152 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPSGPNTTSGLVFSQAGASDIRDQSRNWLPGPCYRQQRVSKQSGQNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 153 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 154 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSNFSWTGATKYHLNGRDSLVNPGPAMASHRDDDDKFFPQSGVLIFGKENAAESNIEIGRVMITDEEEIRTTNPVATEQYGSVSTNLQAGNAQAATADVN

SEQ ID NO: 155 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHAGSKTTSELKFSQAGASDIRDQSRNWLPGPCYRQQRVSKQPSQNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 156 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDTGKFFPQSGVLIFGKEGAGGSNVAVDGVMITDEEEIRTTNPVATEQYGSVSTNLQAGNAQAATADVN

SEQ ID NO: 157 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAGRFFPQSGVLIFGKQGSEKTNVDIEKVMITDEEEIRTTNPVATEQYGSVSTNLQAGNAQAATADVN

SEQ ID NO: 158 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKGRFFPQSGVLIFGKQGSEKTNVDIEKVMITDEEEIRTTNPVATEQYGSVSTNLQAGNAQAATADVN

SEQ ID NO: 159 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKEGTDKANVDIDGVMITDEEEIRTTNPVATEQYGSVSTNLQAGNAQAATADVN

SEQ ID NO: 160 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGSAGSNAAIDNVMITDEEEIRTTNPVATEQYGSVSTNLQAGNAQAATADVN

SEQ ID NO: 161 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 162 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 163 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 164 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQSASGNDVDFDKVMITDEEEIRTTNPVATEQYGSVSTNLQAGNAQAATADVN

SEQ ID NO: 165 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSNFSWTGATTYHLNGRDSLVNPGPAMASHKDDDDRFFPQSGVLIFGKENGTENNVAIDKVMITDEEEIRTTNPVATEQYGSVSTNLQAGNAQAATADVN

SEQ ID NO: 166 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKPKNGAANHEVQ

SEQ ID NO: 167 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDSTGNNIDIEQVMITDEEEIRTTNPVATEQYGSVSTNLQAGNAQAATADVN

SEQ ID NO: 168 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHGDDKGRFFPQSGVLIFGKEGASTSDVAIDHVMITDEEEIRTTNPVATEQYGSVSTNLQAGNAQAATADVN

SEQ ID NO: 169 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 170 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNNTISSLGFSQAGASDIRDQSRNWLPGPCYRQQRVSTQPTHNNNSNFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 171 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSATGPVTTSQLGFSQAGASDIRDQSRNWLPGPCYRQQRVSKTAGRNNNSDFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 172 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGSTTHSTLNFSQAGASDIRDQSRNWLPGPCYRQQRVSKQSGQNNNSDFSWTGATKYHLNGRDSLVNPGPAMASHKDDEGKFFPQSGVLIFGKEGSGKTDVAVGEVMITDEEEIRTTNPVATEQYGSVSTNLQAGNAQAATADVN

SEQ ID NO: 173 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGKGGSTTMSKLMFSQAGASDIRDQSRNWLPGPCYRQQRVSTTPGGNNNSNFSWTGATKYHLNGRDSLVNPGPAMASHKDDDDKFFPQSGVLIFGKQDSGKDNVAFEQVMITDEEEIRTTNPVATEQYGSVSTNLQAGNAQAATADVN

SEQ ID NO: 174 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTKGSAAIENVN

SEQ ID NO: 175 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHTHNNNSNFSWTGATTYHLNGRDSLVNPGPAMASHGDDDDKFFPQSGVLIFGKQGSEKTNVDIEKVMITDEEEIRTTNPVATEQYGSVSTNLQAGNAQAATADVN

SEQ ID NO: 176 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTSGNQTKSGLRFSQAGASDIRDQSRNWLPGPCYRQQRVSKKPDQNNNSEFSWTGATKYHLNGRDSLVNPGPAMASHKDDDDRFFPQSGVLIFGKQGAEKADVEIGGVMITDEEEIRTTNPVATEQYGSVSTNLQAGNAQAATADVN

SEQ ID NO: 177 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDDDKFFPQSGVLIFGKEGAGKTDVAIGRVMITDEEEIRTTNPVATEQYGSVSTNLQAGNAQAATADVN

SEQ ID NO: 178 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATTYHLNGRDSLVNPGPAMASHEDDKDKFFPQSGVLIFGKQGSEKTNVDIEKVMITDEEEIRTTNPVATEQYGSVSTNLQRGNRQAATADVN

SEQ ID NO: 179 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPTGNNNSNFSWTGATKYHLNGRDSLVNPGPAMASHRDDDERFFPQSGVLIFGKESSSKSDAEIEEVMITDEEEIRTTNPVATEQYGSVSTNLQAGNAQAATADVN

SEQ ID NO: 180 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTLSRLQFSQAGASDIRDQSRNWLPGPCYRQQRVSKTDDDNNNSDFSWTGATKYHLNGRDSLVNPGPAMASHEDDDDKFFPQSGVLIFGKQGAGADNVDFDGVMITDEEEIRTTNPVATEQYGSVSTNLQAGNAQAATADVN

SEQ ID NO: 181 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKQSADNNNSDFSWTGATKYHLNGRDSLVNPGPAMASHKDDADKFFPQSGVLIFGKQGAARSNVAFEQVMITDEEEIRTTNPVATEQYGSVSTNLQAGNAQAATADVN

SEQ ID NO: 182 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGTAENNVDFDDVMITDEEEIRTTNPVATEQYGSVSTNLQAGNAQAATADVN

SEQ ID NO: 183 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSTTPTGNNNSDFSWTGATKYHLNGRDSLVNPGPAMASHKDDDDRFFPQSGVLIFGKQNAGKADVAVEQVMITDEEEIRTTNPVATEQYGSVSTNLQAGNAQAATADVN

SEQ ID NO: 184 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSGEANVEFEGVMITDEEEIRTTNPVATEQYGSVSTNLQAGNAQAATADVN

SEQ ID NO: 185 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKDSRNNNSDFSWTGATTYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 186 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGRNTAAASGVE

SEQ ID NO: 187 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGRFFPQSGVLIFGKESAKTADAAVDDVMITDEEEIRTTNPVATEQYGSVSTNLQAGNAQAATADVN

SEQ ID NO: 188 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDGGGTNIEIDKVMITDEEEIRTTNPVATEQYGSVSTNLQAGNAQAATADVN

SEQ ID NO: 189 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 190 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGGATTDAEIDRVMITDEEEIRTTNPVATEQYGSVSTNLQAGNAQAATADVN

SEQ ID NO: 191 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHGDDDDKFFPQSGVLIFGKEDSNGNNIAIDKVMITDEEEIRTTNPVATEQYGSVSTNLQAGNAQAATADVN

SEQ ID NO: 192 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKDSRNNNSDFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 193 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNGGLQTHSRLNFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 194 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 195 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKSGNVTTSGLRFSQAGASDIRDQSRNWLPGPCYRQQRVSKTSDGNNNSDFSWTGATKYHLNGRDSLVNPGPAMASHKDDEEKFFPQSGVLIFGKQNAAGTDIDVDKVMITDEEEIRTTNPVATEQYGSVSTNLQAGNAQAATADVN

SEQ ID NO: 196 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKEGAAGSDVEVDRVMITDEEEIRTTNPVATEQYGSVSTNLQAGNAQAATADVN

SEQ ID NO: 197 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSDFSWTGATTYHLNGRDSLVNPGPAMASHKDDDEKFFPQSGVLIFGKQNAERANTDIGKVMITDEEEIRTTNPVATEQYGSVSTNLQAGNAQAATADVN

SEQ ID NO: 198 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNKTQSALGFSQAGASDIRDQSRNWLPGPCYRQQRVSKTHGDNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 199 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGNITMSTLSFSQAGASDIRDQSRNWLPGPCYRQQRVSKQPSQNNNSNFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 200 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDTDNNNSDFSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 201 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSETTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 202 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSDFSWTGATKYHLNGRDSLVNPGPAMASHRDDAGRFFPQSGVLIFGKEGATATDTAVEDVMITDEEEIRTTNPVATEQYGSVSTNLQAGNAQAATADVN

SEQ ID NO: 203 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSDFSWTGATTYHLNGRDSLVNPGPAMASHRDDTGKFFPQSGVLIFGKQGSEKTNVDIEKVMITDEEEIRTTNPVATEQYGSVSTNLQAGNAQAATADVN

SEQ ID NO: 204 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSHRTGAASNEVT

SEQ ID NO: 205 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKQGAAKDNIAIEKVMITDEEEIRTTNPVATEQYGSVSTNLQAGNAQAATADVN

SEQ ID NO: 206 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 207 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGADRSDVDIGNVMITDEEEIRTTNPVATEQYGSVSTNLQAGNAQAATADVN

SEQ ID NO: 208 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKKPDQNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 209 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHEDDADKFFPQSGVLIFGKQNADRNNVEIGEVMITDEEEIRTTNPVATEQYGSVSTNLQAGNAQAATADVN

SEQ ID NO: 210 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATKYHLNGRDSLVNPGPAMASHKDDTDKFFPQSGVLIFGKQNATGTNVDVGSVMITDEEEIRTTNPVATEQYGSVSTNLQAGNAQAATADVN

SEQ ID NO: 211 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGTTTKSGLRFSQAGASDIRDQSRNWLPGPCYRQQRVSKTSADNNNSEYSWTGATKYHLNGRDSLVNPGPAMASHKDDEEKFFPQSGVLIFGKQGSAASNADVGQVMITDEEEIRTTNPVATEQYGSVSTNLQAGNAQAATADVN

SEQ ID NO: 212 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDEGKFFPQSGVLIFGKENATRGDIAIEDVMITDEEEIRTTNPVATEQYGSVSTNLQAGNAQAATADVN

SEQ ID NO: 213 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKEDTSRGDVEIEKVMITDEEEIRTTNPVATEQYGSVSTNLQAGNAQAATADVN

SEQ ID NO: 214 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDAEKFFPQSGVLIFGKQSSRTTNVAIDDVMITDEEEIRTTNPVATEQYGSVSTNLQAGNAQAATADVN

SEQ ID NO: 215 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKAGSETNSRLKFSQAGASDIRDQSRNWLPGPCYRQQRVSKTSADNNNSEYSWTGATKYHLNGRDSLVNPGPAMASHKDDDEKFFPQSGVLIFGKEGGGKNNIDVEGVMITDEEEIRTTNPVATEQYGSVSTNLQAGNAQAATADVN

SEQ ID NO: 216 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGTNTQSALKFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 217 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKEGAGKSNVEIDNVMITDEEEIRTTNPVATEQYGSVSTNLQAGNAQAATADVN

SEQ ID NO: 218 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGTRKNNVDIEQVMITDEEEIRTTNPVATEQYGSVSTNLQAGNAQAATADVN

SEQ ID NO: 219 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 220 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKQGAAGSDTAIDEVMITDEEEIRTTNPVATEQYGSVSTNLQAGNAQAATADVN

SEQ ID NO: 221 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTSGNQTKSGLRFSQAGASDIRDQSRNWLPGPCYRQQRVSTTPTRNNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 222 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGLTTMSKLRFSQAGASDIRDQSRNWLPGPCYRQQRVSKTYNDNNNSEFSWTGATTYHLNGRDSLVNPGPAMASHKDDEEKFFPQSGVLIFGKESGTANDVDIDRVMITDEEEIRTTNPVATEQYGSVSTNLQAGNAQAATADVN

SEQ ID NO: 223 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDAAGANIEIGNVMITDEEEIRTTNPVATEQYGSVSTNLQAGNAQAATADVN

SEQ ID NO: 224 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDAENNNSEFSWPGATTYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 225 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGSNGTDIDIDKVMITDEEEIRTTNPVATEQYGSVSTNLQAGNAQAATADVN

SEQ ID NO: 226 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRRGQAASAAVH

SEQ ID NO: 227 - protein, 334 aa, Artificial Sequence
  Synthetic
NSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSTTPADNNNSDFSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 228 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKGGRVTTSALGFSQAGASDIRDQSRNWLPGPCYRQQRVSKTSTENNNSEFSWTGATTYHLNGRDSLVNPGPAMASHKDDNGRFFPQSGVLIFGKQSAKAANAAIDEVMITDEEEIRTTNPVATEQYGSVSTNLQAGNAQAATADVN

SEQ ID NO: 229 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSEFSWTGATKYHLNGRDSLVNPGPAMASHGDDKDKFFPQSGVLIFGKEGAGTSDVAFGEVMITDEEEIRTTNPVATEQYGSVSTNLQAGNAQAATADVN

SEQ ID NO: 230 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATKYHLNGRDSLVNPGPAMASHKDDTDKFFPQSGVLIFGKQNATGTNVDVGSVMITDEEEIRTTNPVATEQYGSVSTNLQAGNAQAATADVN

SEQ ID NO: 231 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSTTAAQNNNSDFSWTGATKYHLNGRDSLVNPGPAMASHGDDAERFFPQSGVLIFGKEGANGTNAEIGEVMITDEEEIRTTNPVATEQYGSVSTNLQAGNAQAATADVN

SEQ ID NO: 232 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 233 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRSAPAAFNTVE

SEQ ID NO: 234 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 235 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKQPSENNNSDFSWTGATKYHLNGRDSLVNPGPAMASHKDDEGRFFPQSGVLIFGKESSGKSNIAVEGVMITDEEEIRTTNPVATEQYGSVSTNLQAGNAQAATADVN

SEQ ID NO: 236 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSTTPADNNNSDFSWTGATKYHLNGRDSLVNPGPAMASHKDDDEKFFPQSGVLIFGKQGTRKNDVAIDEVMITDEEEIRTTNPVATEQYGSVSTNLQAGNAQAATADVN

SEQ ID NO: 237 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGATRANVAIDEVMITDEEEIRTTNPVATEQYGSVSTNLQAGNAQAATADVN

SEQ ID NO: 238 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGGNNNSDFSWTGATKYHLNGRDSLVNPGPAMASHKDDEEKFFPQSGVLIFGKEDSRKNNVAYEGVMITDEEEIRTTNPVATEQYGSVSTNLQAGNAQAATADVN

SEQ ID NO: 239 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGSQTLSRLKFSQAGASDIRDQSRNWLPGPCYRQQRVSKKYTDNNNSNFSWTGATTYHLNGRDSLVNPGPAMASHEDDTDKFFPQSGVLIFGKQGSEKTNVDIEKVMITDEEEIRTTNPVATEQYGSVSTNLQAGNAQAATADVN

SEQ ID NO: 240 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGATASNAAFDEVMITDEEEIRTTNPVATEQYGSVSTNLQAGNAQAATADVN

SEQ ID NO: 241 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTAQAQAATGAVD

SEQ ID NO: 242 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDGRAAAANADVA

SEQ ID NO: 243 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDTGKFFPQSGVLIFGKQGASGDNVDIGRVMITDEEEIRTTNPVATEQYGSVSTNLQAGNAQAATADVN

SEQ ID NO: 244 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 245 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQNGSTTNVDIGGVMITDEEEIRTTNPVATEQYGSVSTNLQAGNAQAATADVN

SEQ ID NO: 246 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 247 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESANGNDIEIEDVMITDEEEIRTTNPVATEQYGSVSTNLQAGNAQAATADVN

SEQ ID NO: 248 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRSGPNTTSALMFSQAGASDIRDQSRNWLPGPCYRQQRVSTTSNENNNSDFSWTGATKYHLNGRDSLVNPGPAMASHKDDDEKFFPQSGVLIFGKQGAGGNNVEIGGVMITDEEEIRTTNPVATEQYGSVSTNLQAGNAQAATADVN

SEQ ID NO: 249 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRTQAAYAMVQ

SEQ ID NO: 250 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 251 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGGATGNVDVDKVMITDEEEIRTTNPVATEQYGSVSTNLQAGNAQAATADVD

SEQ ID NO: 252 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDADNNNSDFSWPGATKYHLNGRDSLVNPGPAMASHGDDKEKFFPQSGVLIFGKQGSEKTNVDIEKVMITDEEEIRTTNPVATEQYGSVSTNLQAGNAQAATADVN

SEQ ID NO: 253 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKTYNDNNNSEFSWTGATTYHLNGRDSLVNPGPAMASHKDDDERFFPQSGVLIFGKEGSRKNNSEFGEVMITDEEEIRTTNPVATEQYGSVSTNLQAGNAQAATADVN

SEQ ID NO: 254 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQGSGTSDIDVGQVMITDEEEIRTTNPVATEQYGSVSTNLQAGNAQAATADVN

SEQ ID NO: 255 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQKSRAAVEAVT

SEQ ID NO: 256 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGLQTLSDLRFSQAGASDIRDQSRNWLPGPCYRQQRVSKKYTDNNNSNFSWTGATTYHLNGRDSLVNPGPAMASHEDDDDKFFPQSGVLIFGKEGAKKNNVAVDGVMITDEEEIRTTNPVATEQYGSVSTNLQAGNAQAATADVN

SEQ ID NO: 257 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSMTMSTLKFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVK

SEQ ID NO: 258 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRTQAAYAMVQ

SEQ ID NO: 259 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQYDRNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 260 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTRSRLQFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 261 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKAGSTTLSELRFSQAGASDIRDQSRNWLPGPCYRQQRVSKQSSDNNNSEFSWTGATKYHLNGRDSLVNPGPAMASHGDDEEKFFPQSGVLIFGKEGGTEGDADIDKVMITDEEEIRTTNPVATEQYGSVSTNLQAGNAQAATADVN

SEQ ID NO: 262 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKEGSSTGNIAYEDVMITDEEEIRTTNPVATEQYGSVSTNLQAGNAQAATADVN

SEQ ID NO: 263 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 264 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDERFFPQSGVLIFGKQGTNESDVDIEKVMITDEEEIRTTNPVATEQYGSVSTNLQAGNAQAATADVN

SEQ ID NO: 265 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDTDNNNSDFSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 266 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKQNGDTGNVDIGGVMITDEEEIRTTNPVATEQYGSVSTNLQAGNAQAATADVN

SEQ ID NO: 267 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTTGTVTNSKLRFSQAGASDIRDQSRNWLPGPCYRQQRVSKTDDDNNNSDLSWTGATKYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 268 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKEGTTRSDIEIDRVMITDEEEIRTTNPVATEQYGSVSTNLQAGNAQAATADVN

SEQ ID NO: 269 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSSQSGDNNNSDFSWTGATKYHLNGRDSLVNPGPAMASHKDDDDRFFPQSGVLIFGKQDSRKTNVAFDGVMITDEEEIRTTNPVATEQYGSVSTNLQAGNAQAATADVN

SEQ ID NO: 270 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGRMTMSKLQFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 271 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNGGGNVTLSNLRFSQAGASDIRDQSRNWLPGPCYRQQRVSKTSADNNNSEYSWTGATKYHLNGRDSLVNPGPAMASHKDDDDRFFPQSGVLIFGKQDAGRNNIAIDGVMITDEEEIRTTNPVATEQYGSVSTNLQAGNAQAATADVN

SEQ ID NO: 272 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 273 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGSLTLSRLMFSQAGASDIRDQSRNWLPGPCYRQQRVSKTDGENNNSDFSWTGATKYHLNGRDSLVNPGPAMASHKDDEEKFFPQSGVLIFGKESSDRNNVDIEQVMITDEEEIRTTNPVATEQYGSVSTNLQAGNAQAATADVN

SEQ ID NO: 274 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 275 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNERFFPQSGVLIFGKQNATKDNTAYESVMITDEEEIRTTNPVATEQYGSVSTNLQAGNAQAATADVN

SEQ ID NO: 276 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQTGPLTTSRLRFSQAGASDIRDQSRNWLPGPCYRQQRVSKTAGQNNNSNFSWTGATKYHLNGRDSLVNPGPAMASHKDDDEKFFPQSGVLIFGKQDGGGADVAIDKVMITDEEEIRTTNPVATEQYGSVSTNLQAGNAQAATADVN

SEQ ID NO: 277 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEETNVDIEKVMITDEEEIRTTNPVATEQYGSVSTNLQTSRGGAAITDVQ

SEQ ID NO: 278 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDEEKFFPQSGVLIFGKEGAGKTNIAVDRVMITDEEEIRTTNPVATEQYGSVSTNLQAGNAQAATADIN

SEQ ID NO: 279 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKPNGPAAVAMVN

SEQ ID NO: 280 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSEFSWTGATKYHLNGRDSLVNPGPAMASHKDDDDRFFPQSGVLIFGKQGAGTTDVEYGQVMITDEEEIRTTNPVATEQYGSVSTNLQAGNAQAATADVN

SEQ ID NO: 281 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKRDTDNNNSDFSWTGATKYHLNGRDSLVNPGPAMASHKDDNEKFFPQSGVLIFGKEGSERSNVDFEQVMITDEEEIRTTNPVATEQYGSVSTNLQAGNAQAATADVN

SEQ ID NO: 282 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKQGSEKTNVDIEKVMITDEEEIRTTNPVATEQYGSVSTNLQAGNAQAATADVN

SEQ ID NO: 283 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEESFFPQSGVLIFGKQGSEKTNVDIEKVMITDEEEIRTTNPVATEQYGSVSTNLQRGNRQAATADVN

SEQ ID NO: 284 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEESFFPQSGVLIFGKEDGGGTNIEIDKVMITDEEEIRTTNPVATEQYGSVSTNLQAGNAQAATADVN

SEQ ID NO: 285 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 286 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGTSGNQTKSGLRFSQAGASDIRDQSRNWLPGPCYRQQRVSKKPDQSNNSEFSWTGATKYHLNGRDSLVNPGPAMASHKDDDDRFFPQSGVLIFGKQGAEKADVEIGGVMITDEEEIRTTNPVATEQYGSVSTNLQAGNAQAATADVN

SEQ ID NO: 287 - protein, 334 aa, Artificial Sequence
  Synthetic
QSGAANDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 288 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTPSDGNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 289 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTADDNNNSDFSWTGATTYHLNGRDSLVNPGPAMASHKDDDGKFFPQSGVLIFGKENSARGNVEIERVMITDEEEIRTTNPVATEQYGSVSTNLQAGNAQAATADVN

SEQ ID NO: 290 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKGGRVTTSALGFSQAGASDIRDQSRNWLPGPCYRQQRVSKTSTENNNSEFSWTGATTYHLNGRDSLVNPGPAMASHKDDNGRFFPQSGVLIFGKQSAKAANAAIDEVMITDEEEIRTTNPVATEQYGSVSTNLQRGNRQAATADVN

SEQ ID NO: 291 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQRRRKTNIAYGNVMITDEEEIRTTNPVATEQYGSVSTNLQAGNAQAATADVN

SEQ ID NO: 292 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHMTMSSLMFSQAGASDIRDQSRNWLPGPCYRQQRVSTTPADNNNSDFSWTGATKYHLNGRDSLVNPGPAMASHKDDDEKFFPQSGVLIFGKHGSEKTNVDIEKVMITDEEEIRTTNPVATEQYGSVSTNLQAGNAQAATADVN

SEQ ID NO: 293 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNKTQSALGFSQAGASDIRDQSRNWLPGPCYRQQRVSKVSADNNNSEFSWTGATKYHLNGRDSLVNPGPAMASHKDDEEKFFPQSGVLIFGKQSSARGDIDIDNVMITDEEEIRTTNPVATEQYGSVSTNLQAGNAQAATADVN

SEQ ID NO: 294 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSANNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 295 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEESFFPQSGVLIFGKQGSEKTNVDIEKVMITDEEEIRTTNPVATEQYGSVSTNLQGGKGQAASGDVE

SEQ ID NO: 296 - protein, 334 aa, Artificial Sequence; identical to SEQ ID NO: 282
  Synthetic

SEQ ID NO: 297 - protein, 334 aa, Artificial Sequence; identical to SEQ ID NO: 31
  Synthetic

SEQ ID NO: 298 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQASDNNNSEFSWTGATKYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 299 - protein, 334 aa, Artificial Sequence; identical to SEQ ID NO: 115
  Synthetic

SEQ ID NO: 300 - protein, 334 aa, Artificial Sequence; identical to SEQ ID NO: 161
  Synthetic

SEQ ID NO: 301 - protein, 334 aa, Artificial Sequence; identical to SEQ ID NO: 105
  Synthetic

SEQ ID NO: 302 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 303 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 304 - protein, 334 aa, Artificial Sequence; identical to SEQ ID NO: 45
  Synthetic

SEQ ID NO: 305 - protein, 334 aa, Artificial Sequence; identical to SEQ ID NO: 153
  Synthetic

SEQ ID NO: 306 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 307 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTTSTLQFSQAGASDIRDQSRNWLPGPCYRQQRVSTQSSDNNNSDFSWTGATKYHLNGRDSLVNPGPAMASHRDDDDKFFPQSGVLIFGKEGSTAANAAFDEVMITDEEEIRTTNPVATEQYGSVSTNLQAGNAQAATADVN

SEQ ID NO: 308 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 309 - protein, 334 aa, Artificial Sequence; identical to SEQ ID NO: 61
  Synthetic

SEQ ID NO: 310 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 311 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 312 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 313 - protein, 334 aa, Artificial Sequence; identical to SEQ ID NO: 44
  Synthetic

SEQ ID NO: 314 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTHTENNNSNFSWTGATTYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 315 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNEKFFPQSGVLIFGKQGSEKTNVDIEKVMITDEEEIRTTNPVATEQYGSVSTNLQRGNRQAATADVN

SEQ ID NO: 316 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQGGIATQSRLKFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 317 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQSTGADNVDIEKVMITDEEEIRTTNPVATEQYGSVSTNLQAGNAQAATADVN

SEQ ID NO: 318 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 319 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSGKNNADIEKVMITDEEEIRTTNPVATEQYGSVSTNLQAGNAQAATADVN

SEQ ID NO: 320 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 321 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 322 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKTYNDNNNSEFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 323 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSATKNNIAIEHVMITDEEEIRTTNPVATEQYGSVSTNLQAGNAQAATADVN

SEQ ID NO: 324 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKGDTTGSNAAIEEVMITDEEEIRTTNPVATEQYGSVSTNLQAGNAQAATADVN

SEQ ID NO: 325 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTARSAAAVDGVA

SEQ ID NO: 326 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDDKFFPQSGVLIFGKEDAGKADVEIERVMITDEEEIRTTNPVATEQYGSVSTNLQRGNRQAATADVN

SEQ ID NO: 327 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGATGINTMSKLLFSQAGASDIRDQSRNWLPGPCYRQQRVSTTANENNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 328 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 329 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRNDTAAFTEVD

SEQ ID NO: 330 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRHNEAASAVVQ

SEQ ID NO: 331 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNAAANNVEFEHVMITDEEEIRTTNPVATEQYGSVSTNLQAGNAQAATADVN

SEQ ID NO: 332 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPDNRNNTSDFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 333 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWPGATTYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 334 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKEGATASNAAFDEVMITDEEEIRTTNPVATEQYGSVSTNLQAGNAQAATADVN

SEQ ID NO: 335 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASTGINTLSTLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 336 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDADKFFPQSGVLIFGKQNARKANIDIGEVMITDEEEIRTTNPVATEQYGSVSTNLQAGNAQAATADVN

SEQ ID NO: 337 - protein, 334 aa, Artificial Sequence; identical to SEQ ID NO: 56
  Synthetic

SEQ ID NO: 338 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNGGPTTQSTLRFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 339 - protein, 334 aa, Artificial Sequence; identical to SEQ ID NO: 273
  Synthetic

SEQ ID NO: 340 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKESSDRNNVAIDNVMITDEEEIRTTNPVATEQYGSVSTNLQAGNAQAATADVN

SEQ ID NO: 341 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKEDAGTTNAAIEHVMITDEEEIRTTNPVATEQYGSVSTNLQAGNAQAATADVN

SEQ ID NO: 342 - protein, 334 aa, Artificial Sequence; identical to SEQ ID NO: 73
  Synthetic

SEQ ID NO: 343 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRTAAATSGVH

SEQ ID NO: 344 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRDGAAAEDVA

SEQ ID NO: 345 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 346 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDANGTNVEVENVMITDEEEIRTTNPVATEQYGSVSTNLQAGNAQAATADVN

SEQ ID NO: 347 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRDKAAFEGVN

SEQ ID NO: 348 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 349 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDQRGTAATRGVD

SEQ ID NO: 350 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGSPTHSELVFSQAGASDIRDQSRNWLPGPCYRQQRVSKTHGDNNNSNFSWTGATTYHLNGRDSLVNPGPAMASHKDDDDRFFPQSGVLIFGKEGAGANDVAVEHVMITDEEEIRTTNPVATEQYGSVSTNLQAGNAQAATADVN

SEQ ID NO: 351 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARGGAAFNMVQ

SEQ ID NO: 352 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDDGKFFPQSGVLIFGKEDAGTTNVAFDKVMITDEEEIRTTNPVATEQYGSVSTNLQAGNAQAATADVN

SEQ ID NO: 353 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKTGSLTQSGLRFSQAGASDIRDQSRNWLPGPCYRQQRVSKTAADNNNSDFSWTGATKYHLNGRDSLVNPGPAMASHKDDDGKFFPQSGVLIFGKENANGNNIAFDKVMITDEEEIRTTNPVATEQYGSVSTNLQAGNAQAATADVN

SEQ ID NO: 354 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQERSGAAAIEDVD

SEQ ID NO: 355 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 356 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQREKGGAATQNVN

SEQ ID NO: 357 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAGKSNVDIEKVMITDEEEIRTTNPVATEQYGSVSTNLQAGNAQAATADVN

SEQ ID NO: 358 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 359 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGARRGDVAIDEVMITDEEEIRTTNPVATEQYGSVSTNLQAGNAQAATADVN

SEQ ID NO: 360 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 361 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNQHNAAAFQTVP

SEQ ID NO: 362 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 363 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 364 - protein, 334 aa, Artificial Sequence; identical to SEQ ID NO: 94
  Synthetic

SEQ ID NO: 365 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTPAENNNSNFSWTGATTYHLNGRDSLVNPGPAMASHEDDDGKFFPQSGVLIFGKEGGARTNAAIEQVMITDEEEIRTTNPVATEQYGSVSTNLQAGNAQAATADVN

SEQ ID NO: 366 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQDHRNPAADQAVN

SEQ ID NO: 367 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 368 - protein, 334 aa, Artificial Sequence; identical to SEQ ID NO: 232
  Synthetic

SEQ ID NO: 369 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKEDAGRNNVDVENVMITDEEEIRTTNPVATEQYGSVSTNLQAGNAQAATADVN

SEQ ID NO: 370 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDGGTTTKSQLRFSQAGASDIRDQSRNWLPGPCYRQQRVSKVSADNNNSEFSWTGATKYHLNGRDSLVNPGPAMASHKDDDDRFFPQSGVLIFGKQSAKAANAAIDEVMITDEEEIRTTNPVATEQYGSVSTNLQAGNAQAATADVN

SEQ ID NO: 371 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSGKDNVEVGQVMITDEEEIRTTNPVATEQYGSVSTNLQAGNAQAATADVN

SEQ ID NO: 372 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKQGASAADVEIEDVMITDEEEIRTTNPVATEQYGSVSTNLQAGNAQAATADVN

SEQ ID NO: 373 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDKFFPQSGVLIFGKQGATTTNTDFEQVMITDEEEIRTTNPVATEQYGSVSTNLQAGNAQAATADVN

SEQ ID NO: 374 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDNHNNNSNFSWTGATTYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 375 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEGAGGNNVEIDDVMITDEEEIRTTNPVATEQYGSVSTNLQAGNAQAATADVN

SEQ ID NO: 376 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTARTAAASQVVH

SEQ ID NO: 377 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKDKFFPQSGVLIFGKESAGANNVDIGGVMITDEEEIRTTNPVATEQYGSVSTNLQAGNAQAATADVN

SEQ ID NO: 378 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 379 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKQGAGENNVAIEGVMITDEEEIRTTNPVATEQYGSVSTNLQAGNAQAATADVN

SEQ ID NO: 380 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKQGSEKTNVDIEKVMITDEEEIRTTNPVATEQYGSVSTNLQAGNRQAATADVN

SEQ ID NO: 381 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTMQSRLQFSQAGASDIRDQSRNWLPGPCYRQQRVSKTSADNNNSEYSWTGATKYHLNGRDSLVNPGPAMASHKDDNDRFFPQSGVLIFGKQGAKGTNVAVEKVMITDEEEIRTTNPVATEQYGSVSTNLQAGNAQAATADVN

SEQ ID NO: 382 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHEDDTDKFFPQSGVLIFGKQGSEKTNVDIEKVMITDEEEIRTTNPVATEQYGSVSTNLQRGNRQAATADVN

SEQ ID NO: 383 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPKNPAADRTVD

SEQ ID NO: 384 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDSRGGAAFSEVN

SEQ ID NO: 385 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 386 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGNSGIKTLSRLGFSQAGASDIRDQSRNWLPGPCYRQQRVSKQASDNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 387 - protein, 334 aa, Artificial Sequence; identical to SEQ ID NO: 101
  Synthetic

SEQ ID NO: 388 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSTLNFSQAGASDIRDQSRNWLPGPCYRQQRVSKTSADNNNSEYSWTGATKYHLNGRDSLVNPGPAMASHKDDEEKFFPQSGVLIFGKQGTGKDNVAIGGVMITDEEEIRTTNPVATEQYGSVSTNLQAGNAQAATADVN

SEQ ID NO: 389 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDAKGDNADFEDVMITDEEEIRTTNPVATEQYGSVSTNLQAGNAQAATADVN

SEQ ID NO: 390 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 391 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGNPTPSDLRFSQAGASDIRDQSRNWLPGPCYRQQRVSKQASDNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 392 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPAGNNNSNFSWTGATKYHLNGRDSLVNPGPAMASHRDDEDKFFPQSGVLIFGKRGSNGTNVDVDGVMITDEEEIRTTNPVATEQYGSVSTNLQAGNAQAATADVN

SEQ ID NO: 393 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 394 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAEKFFPQSGVLIFGKQGSEKTNVDIEKVMITDEEEIRTTNPVATEQYGSVSTNLQAGNAQAATADVN

SEQ ID NO: 395 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 396 - protein, 334 aa, Artificial Sequence; identical to SEQ ID NO: 178
  Synthetic

SEQ ID NO: 397 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSVDNNNSEFSWTGATKYHLNGRDSLVNPGPAMASHKDDEEKFFPQSGVLIFGKQGSEKTNVDIEKVMITDEEEIRTTNPVATEQYGSVSTNLQGARATAASQDVN

SEQ ID NO: 398 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTLSNLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 399 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATKYHLNGRDSLVNPGPAMASHKDDDEKFFPQSGVLIFGKQNAGKDDVDIDQVMITDEEEIRTTNPVATEQYGSVSTNLQAGNAQAATADVN

SEQ ID NO: 400 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEGAGKTDVAIGRVMITDEEEIRTTNPVATEQYGSVSTNLQAGNAQAATADVN

SEQ ID NO: 401 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKEGASGGNADIGSVMITDEEEIRTTNPVATEQYGSVSTNLQAGNAQAATADVN

SEQ ID NO: 402 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKEGSGKSDAAIGDVMITDEEEIRTTNPVATEQYGSVSTNLQRGNAQAATADVN

SEQ ID NO: 403 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKEGTNAANIDFDRVMITDEEEIRTTNPVATEQYGSVSTNLQAGNAQAATADVN

SEQ ID NO: 404 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKESATGGNTDIGGVMITDEEEIRTTNPVATEQYGSVSTNLQAGNAQAATADVN

SEQ ID NO: 405 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKTHDGNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 406 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKESGGADNIDIERVMITDEEEIRTTNPVATEQYGSVSTNLQAGNAQAATADVN

SEQ ID NO: 407 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQSGETNNTDIDKVMITDEEEIRTTNPVATEQYGSVSTNLQAGNAQAATADVN

SEQ ID NO: 408 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDDERFFPQSGVLIFGKQGSEKTNVDIEKVMITDEEEIRTTNPVATEQYGSVSTNLQAGNAQAATADVN

SEQ ID NO: 409 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRRDGAAIASVE

SEQ ID NO: 410 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDERFFPQSGVLIFGKEGAAAANIDIDKVMITDEEEIRTTNPVATEQYGSVSTNLQAGNAQAATADVN

SEQ ID NO: 411 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 412 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGAGANDVAYENVMITDEEEIRTTNPVATEQYGSVSTNLQAGNAQAATADVN

SEQ ID NO: 413 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDTGKFFPQSGVLIFGKQSAKAANAAIDEVMITDEEEIRTTNPVATEQYGSVSTNLQAGNAQAATADVN

SEQ ID NO: 414 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAQRAGAAVDAVQ

SEQ ID NO: 415 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 416 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTERGTAASDDVN

SEQ ID NO: 417 - protein, 334 aa, Artificial Sequence; identical to SEQ ID NO: 157
  Synthetic

SEQ ID NO: 418 - protein, 334 aa, Artificial Sequence; identical to SEQ ID NO: 116
  Synthetic

SEQ ID NO: 419 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRSTAAFREVT

SEQ ID NO: 420 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQSADGSDVDIDRVMITDEEEIRTTNPVATEQYGSVSTNLQAGNAQAATADVN

SEQ ID NO: 421 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQSAGRGDAAVDEVMITDEEEIRTTNPVATEQYGSVSTNLQAGNAQAATADVN

SEQ ID NO: 422 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQNGSTTNVDIGGVMITDEEEIRTTNPVATEQYGSVSTNLQAGNAQAATADVN

SEQ ID NO: 423 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSQRASAASDKVD

SEQ ID NO: 424 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKQGSEKTNVDIEKVMITDEEEIRTTNPVATEQYGSVSTNLQRGNRQAATADVN

SEQ ID NO: 425 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKGGNLTQSQLSFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 426 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQNGGAADAEIEHVMITDEEEIRTTNPVATEQYGSVSTNLQAGNAQAATADVN

SEQ ID NO: 427 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGHPTTSGLMFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 428 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDAERFFPQSGVLIFGKQGSEKTNVDIEKVMITDEEEIRTTNPVATEQYGSVSTNLQAGNAQAATADVN

SEQ ID NO: 429 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDAENNNSEFSWPGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 430 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRQDSAANRDVE

SEQ ID NO: 431 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSDFSWTGATKYHLNGRDSLVNPGPAMASHGDDKGRFFPQSGVLIFGKQDASKNNVDVDGVMITDEEEIRTTNPVATEQYGSVSTNLQAGNAQAATADVN

SEQ ID NO: 432 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESANKTNIDIEHVMITDEEEIRTTNPVATEQYGSVSTNLQAGNAQAATADVN

SEQ ID NO: 433 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQRGNAQAATADVN

SEQ ID NO: 434 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAKNTEAATGDVN

SEQ ID NO: 435 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKESATGGNTDIGGVMITDEEEIRTTNPVATEQYGSVSTNLQAGNAQAATADVN

SEQ ID NO: 436 - protein, 334 aa, Artificial Sequence; identical to SEQ ID NO: 86
  Synthetic

SEQ ID NO: 437 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGKRDQAAAGEVK

SEQ ID NO: 438 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKEGSTAANAAFDEVMITDEEEIRTTNPVATEQYGSVSTNLQAGNAQAATADVN

SEQ ID NO: 439 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPSGSTTMSTLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 440 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTKSRLQFSQAGASDIRDQSRNWLPGPCYRQQRVSKTSADNNNSEYSWTGATKYHLNGRDSLVNPGPAMASHKDDDERFFPQSGVLIFGKQGTGASNADIDHVMITDEEEIRTTNPVATEQYGSVSTNLQAGNAQAATADVN

SEQ ID NO: 441 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSGTTNAAIGDVMITDEEEIRTTNPVATEQYGSVSTNLQAGNAQAATADVN

SEQ ID NO: 442 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEYSWTGATKYHLNGRDSLVNPGPAMASHKDDEEKFFPQSGVLIFGKEGAAGNDVEFDQVMITDEEEIRTTNPVATEQYGSVSTNLQRGNRQAATADVN

SEQ ID NO: 443 - protein, 334 aa, Artificial Sequence; identical to SEQ ID NO: 29
  Synthetic

SEQ ID NO: 444 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSSDNNNSEFSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 445 - protein, 334 aa, Artificial Sequence; identical to SEQ ID NO: 39
  Synthetic

SEQ ID NO: 446 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 447 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 448 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 449 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQGSEKKNVDIEKVMITDEEEIRTTNPVATEQYGSVSTNLQAGNAQAATADVN

SEQ ID NO: 450 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSDFSWTGATTYHLNGRDSLVNPGPAMASHEDDNDKFFPQSGVLIFGKEGAGRDDVDIDRVMITDEEEIRTTNPVATEQYGSVSTNLQAGNAQAATADVN

SEQ ID NO: 451 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGARTADTEIDSVMITDEEEIRTTNPVATEQYGSVSTNLQAGNAQAATADVN

SEQ ID NO: 452 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 453 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 454 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 455 - protein, 334 aa, Artificial Sequence; identical to SEQ ID NO: 244
  Synthetic

SEQ ID NO: 456 - protein, 334 aa, Artificial Sequence; identical to SEQ ID NO: 206
  Synthetic

SEQ ID NO: 457 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEDKFFPQSGVLIFGKESGSKSNIAIDQVMITDEEEIRTTNPVATEQYGSVSTNLQAGNAQAATADVN

SEQ ID NO: 458 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARATAASQDVN

SEQ ID NO: 459 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 460 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSEFSWTGATKYHLNGRDSLVNPGPAMASHKDDEEKFFPQSGVLIFGKQGSEKTNVDIEKVMITDEEEIRTTNPVATEQYGSVSTNLQGTRGGAATKDVD

SEQ ID NO: 461 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 462 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQNAAANNVEFEHVMITDEEEIRTTNPVATEQYGSVSTNLQAGNAQAATADVN

SEQ ID NO: 463 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHRDAAATEGVE

SEQ ID NO: 464 - protein, 334 aa, Artificial Sequence; identical to SEQ ID NO: 196
  Synthetic

SEQ ID NO: 465 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 466 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGTNTTSRLGFSQAGASDIRDQSRNWLPGPCYRQQRVSKQPNQNNNSNFSWPGATTYHLNGRDSLVNPGPAMASHKDDEERFFPQSGVLIFGKQGSEKTNVDIEKVMITDEEEIRTTNPVATEQYGSVSTNLQAGNAQAATADVN

SEQ ID NO: 467 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDGGTTTKSQLRFSQAGASDIRDQSRNWLPGPCYRQQRVSKVSADNNNSEFSWTGATKYHLNGRDSLVNPGPAMASHKDDDDRFFPQSGVLIFGKQSAKAANAAIDEVMITDEEEIRTTNPVATEQYGSVSTNLQTGNAQAATADVN

SEQ ID NO: 468 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKQGSEKTNVDIEKVMITDEEEIRTTNPVATEQYGSVSTNLQAGNTQAATADVN

SEQ ID NO: 469 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTATQSTLNFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 470 - protein, 334 aa, Artificial Sequence; identical to SEQ ID NO: 218
  Synthetic

SEQ ID NO: 471 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 472 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNAAANNVEFEHVMITDEEEIRTTNPVATEQYGSVSTNLQAGNAQAATADVN

SEQ ID NO: 473 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNSNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 474 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYCLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAGKSNVDIEKVMITDEEEIRTTNPVATEQYGSVSTNLQAGNAQAATADVN

SEQ ID NO: 475 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNADIEKVMITDEEEIRTTNPVATEQYGSVSTNLQDQRGTAATRGVD

SEQ ID NO: 476 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 477 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEERFFPQSGVLIFGKQGSEKTNVDIEKVMITDEEEIRTTNPVATEQYGSVSTNLQRGNRQAATADVN

SEQ ID NO: 478 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHRLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 479 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDAGKFFPQSGVLIFGKQGSEKTNVDIEKVMITDEEEIRTTNPVATEQYGSVSTNLQRGNRQAATADVN

SEQ ID NO: 480 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 481 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGRETISRLQFSQAGASDIRDQSRNWLPGPCYRQQRVSTKATDNNNSNFSWTGATTYHLNGRDSLVNPGPAMASHRDDAGKFFPQSGVLIFGKESAGKTNVAIGEVMITDEEEIRTTNPVATEQYGSVSTNLQAGNAQAATADVN

SEQ ID NO: 482 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSDFSWTGATKYHLNGRDSLVNPGPAMASHGDDKGRFFPQSGVLIFGKQDASKNNVDVDGVMITDEEEIRTTNPVATEQYGSVSTNLQAGNAQAATADVN

SEQ ID NO: 483 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGTKTMSRLEFSQAGASDIRDQSRNWLPGPCYRQQRVSKTSADNNNSEYSWTGATKYHLNGRDSLVNPGPAMASHKDDEEKFFPQSGVLIFGKQGAGKNNVAFERVMITDEEEIRTTNPVATEQYGSVSTNLQAGNAQAATADVN

SEQ ID NO: 484 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRHQFSQAGASDIRDQSRNWLPGPCYRQQRVSKTSADNNNSEYSWTGATKYHLNGRDSLVNPGPAMASHKDDDEKFFPQSGVLIFGKQSTGADNVDIEKVMITDEEEIRTTNPVATEQYGSVSTNLQAGNAQAATADVN

SEQ ID NO: 485 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQSTGADNVDIEKVMITDEEEIRTTNPVATEQYGSVSTNLQAGNAQAATADVN

SEQ ID NO: 486 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDAENNNSEFSWPGATKYHLNGRDSLVNPGPAMASHKDDDEKFFPQSGVLIFGKQGSEKTNVDIEKVMITDEEEIRTTNPVATEQYGSVSTNLQRGNRPAATADVN

SEQ ID NO: 487 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKESAAGDNIEIGDVMITDEEEIRTTNPVATEQYGSVSTNLQAGNAQAATADVN

SEQ ID NO: 488 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 489 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDANGTNVEVENVMITDEEEIRTTNPVATEQYGSVSTNLQAGNAQAATADVN

SEQ ID NO: 490 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNDNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 491 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNSNSEYSWTGATKYHLNGRDSLVNPGPAMASHRDDEEKFFPQSGVLIFGKQGSEKTNVDIEKVMITDEEEIRTTNPVATEQYGSVSTNLQAGNAQAATADVN

SEQ ID NO: 492 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 493 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 494 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEEFFPQSGVLIFGKQGSEKTNVDIEKVMITDEEEIRTTNPVATEQYGSVSTNLQAGNAQAATADVN

SEQ ID NO: 495 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEESFFPQSGVLIFGKQGSEKTNVDIEKVMITDEEEIRTTNPVATEQYGSVSTNLQGARGGAAFNMVQ

SEQ ID NO: 496 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPDNRNNTSDFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 497 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKEDAGTTNAAIEHVMITDEEEIRTTNPVATEQYGSVSTNLQAGNAQAATADVN

SEQ ID NO: 498 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEGRFFPQSGVLIFGKEDTGKANVDIGNVMITDEEEIRTTNPVATEQYGSVSTNLQAGNAQAATADVN

SEQ ID NO: 499 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEDKFFPQSGVLIFGKQGSEKTNVDIEKVMITDEEEIRTTNPVATEQYGSVSTNLQGPKNPAADRTVD

SEQ ID NO: 500 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTHTENNNSNFSWTGATTYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 501 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQASDNNNSEFSWTGATKYHLNGRDSLVNPGPAMASHRDDNDKFFPQSGVLIFGKQGSEETNVDIEKVMITDEEEIRTTNPVATEQYGSVSTNLQAGNAQAATADVN

SEQ ID NO: 502 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 503 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 504 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDGEEKFFPQSGVLIFGKQGSEKTNVDIEKVMITDEEEIRTTNPVATEQYGSVSTNLQTARSAAAVDGVA

SEQ ID NO: 505 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDAERFFPQSGVLIFGKQGSEKTNVDIEKVMITDEEEIRTTNPVATEQYGSVSTNLQAGNTQAATADVN

SEQ ID NO: 506 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 507 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 508 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 509 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 510 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 511 - protein, 334 aa, Artificial Sequence
  Synthetic
QSGAPNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTMQSRLQFSQAGASDIRDQSRNWLPGPCYRQQRVSKTSADNNNSEYSWTGATKYHLNGRDSLVNPGPAMASHKDDNDRFFPQSGVLIFGKQGAKGTNVAVEKVMITDEEEIRTTNPVATEQYGSVSTNLQAGNAQAATADVN

SEQ ID NO: 512 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 513 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKEGTNAANIDFDRVMITDEEEIRTTNPVATEQYGSVSTNLQAGNAQAATADVN

SEQ ID NO: 514 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLMTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 515 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNEEFFPQSGVLIFGKQGSEKTNVDIEKVMITDEEEIRTTNPVATEQYGSVSTNLQRGNRQAATADVN

SEQ ID NO: 516 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAEKTNVDIEKVMITDEEEIRTTNPVATEQYGSVSTNLQAGNAQAATADVN

SEQ ID NO: 517 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKEDAGRNNVDVENVMITDEEEIRTTNPVATEQYGSVSTNLQAGNAQAATADVN

SEQ ID NO: 518 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKQGSEETNVDIEKVMITDEEEIRTTNPVATEQYGSVSTNLQAGNAQAATADVN

SEQ ID NO: 519 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 520 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTRATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 521 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNDNSEFSWTGATKYHLNGRDSLVNPGPAMASHKDDEEKFFPQSGVLIFGKQGSEKTNVDIEKVMITDEEEIRTTNPVATEQYGSVSTNLQSQRASAASDKVD

SEQ ID NO: 522 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQPRLQFSQAGASDIRDQSRNWLPGPCYRQQRVSKTSADNNNSEYSWTGATKYHLNGRDSLVNPGPAMASHRDDEEKFFPQSGVLIFGKQGSEKTNVDIEKVMITDEEEIRTTNPVATEQYGSVSTNLQAGNAQAATADVN

SEQ ID NO: 523 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSRTSADNNNSEYSWTGATKYHLNGRDSLVNPGPAMASHEDDNEKFFPQSGVLIFGKEGATASNAAFDEVMITDEEEIRTTNPVATEQYGSVSTNLQAGNAQAATADVN

SEQ ID NO: 524 - protein, 334 aa, Artificial Sequence; identical to SEQ ID NO: 30
  Synthetic

SEQ ID NO: 525 - protein, 334 aa, Artificial Sequence; identical to SEQ ID NO: 44
  Synthetic

SEQ ID NO: 526 - protein, 334 aa, Artificial Sequence; identical to SEQ ID NO: 400
  Synthetic

SEQ ID NO: 527 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 528 - protein, 334 aa, Artificial Sequence; identical to SEQ ID NO: 94
  Synthetic

SEQ ID NO: 529 - protein, 334 aa, Artificial Sequence; identical to SEQ ID NO: 31
  Synthetic

SEQ ID NO: 530 - protein, 334 aa, Artificial Sequence; identical to SEQ ID NO: 308
  Synthetic

SEQ ID NO: 531 - protein, 334 aa, Artificial Sequence; identical to SEQ ID NO: 328
  Synthetic

SEQ ID NO: 532 - protein, 334 aa, Artificial Sequence; identical to SEQ ID NO: 124
  Synthetic

SEQ ID NO: 533 - protein, 334 aa, Artificial Sequence; identical to SEQ ID NO: 395
  Synthetic

SEQ ID NO: 534 - protein, 334 aa, Artificial Sequence; identical to SEQ ID NO: 415
  Synthetic

SEQ ID NO: 535 - protein, 334 aa, Artificial Sequence; identical to SEQ ID NO: 29
  Synthetic

SEQ ID NO: 536 - protein, 334 aa, Artificial Sequence; identical to SEQ ID NO: 115
  Synthetic

SEQ ID NO: 537 - protein, 334 aa, Artificial Sequence; identical to SEQ ID NO: 232
  Synthetic

SEQ ID NO: 538 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANSGTNTLSHLRFSQAGASDIRDQSRNWLPGPCYRQQRVSKTDADNNNSNFSWTGATKYHLNGRDSLVNPGPAMASHRDDEDKFFPQSGVLIFGKQSGAGTDVDYEEVMITDEEEIRTTNPVATEQYGSVSTNLQAGNAQAATADVN

SEQ ID NO: 539 - protein, 334 aa, Artificial Sequence; identical to SEQ ID NO: 153
  Synthetic

SEQ ID NO: 540 - protein, 334 aa, Artificial Sequence; identical to SEQ ID NO: 39
  Synthetic

SEQ ID NO: 541 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGKAGAATEGVQ

SEQ ID NO: 542 - protein, 334 aa, Artificial Sequence; identical to SEQ ID NO: 393
  Synthetic

SEQ ID NO: 543 - protein, 334 aa, Artificial Sequence; identical to SEQ ID NO: 161
  Synthetic

SEQ ID NO: 544 - protein, 334 aa, Artificial Sequence; identical to SEQ ID NO: 96
  Synthetic

SEQ ID NO: 545 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTPSALKFSQAGASDIRDQSRNWLPGPCYRQQRVSKQPGDNNNSNFSWTGATKYHLNGRDSLVNPGPAMASHKDDDDRFFPQSGVLIFGKEGGGENNVEFESVMITDEEEIRTTNPVATEQYGSVSTNLQAGNAQAATADVN

SEQ ID NO: 546 - protein, 334 aa, Artificial Sequence; identical to SEQ ID NO: 303
  Synthetic

SEQ ID NO: 547 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRAGINTMSKLLFSQAGASDIRDQSRNWLPGPCYRQQRVSKQSSDNNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 548 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQGSEKTNVDIEKVMITDEEEIRTTNPVATEQYGSVSTNLQRGNRQAATADVN

SEQ ID NO: 549 - protein, 334 aa, Artificial Sequence; identical to SEQ ID NO: 488
  Synthetic

SEQ ID NO: 550 - protein, 334 aa, Artificial Sequence; identical to SEQ ID NO: 479
  Synthetic

SEQ ID NO: 551 - protein, 334 aa, Artificial Sequence; identical to SEQ ID NO: 237
  Synthetic

SEQ ID NO: 552 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGKFFPQSGVLIFGKQGSEKTNVDIEKVMITDEEEIRTTNPVATEQYGSVSTNLQRGNRQAATADVN

SEQ ID NO: 553 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 554 - protein, 334 aa, Artificial Sequence; identical to SEQ ID NO: 380
  Synthetic

SEQ ID NO: 555 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 556 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 557 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGSVTQSHLRFSQAGASDIRDQSRNWLPGPCYRQQRVSKTAADNNNSDFSWTGATKYHLNGRDSLVNPGPAMASHKDDDGKFFPQSGVLIFGKEGTNKGDVDYESVMITDEEEIRTTNPVATEQYGSVSTNLQAGNAQAATADVN

SEQ ID NO: 558 - protein, 334 aa, Artificial Sequence; identical to SEQ ID NO: 219
  Synthetic

SEQ ID NO: 559 - protein, 334 aa, Artificial Sequence; identical to SEQ ID NO: 476
  Synthetic

SEQ ID NO: 560 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 561 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 562 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQGSEKTNVDIEKVMITDEEEIRTTNPVATEQYGSVSTNLQRGNRQAATADVN

SEQ ID NO: 563 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 564 - protein, 334 aa, Artificial Sequence; identical to SEQ ID NO: 43
  Synthetic

SEQ ID NO: 565 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKESATGDNVEIGQVMITDEEEIRTTNPVATEQYGSVSTNLQAGNAQAATADVN

SEQ ID NO: 566 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 567 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNKTMSALRFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 568 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAKGGNMTLSRLKFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 569 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTQRDAAASSGVT

SEQ ID NO: 570 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSGGNNNSNFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 571 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKQGSEKTNVDIEKVMITDEEEIRTTNPVATEQYGSVSTNLQAGNRQAATADVN

SEQ ID NO: 572 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPAGNNNSNFSWTGATKYHLNGRDSLVNPGPAMASHRDDEDKFFPQSGVLIFGKQGSNGTNVDVDGVMITDEEEIRTTNPVATEQYGSVSTNLQAGNAQAATADVN

SEQ ID NO: 573 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 574 - protein, 334 aa, Artificial Sequence; identical to SEQ ID NO: 385
  Synthetic

SEQ ID NO: 575 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHRDDAGRFFPQSGVLIFGKQGSEKTNVDIEKVMITDEEEIRTTNPVATEQYGSVSTNLQAGNAQAATADVN

SEQ ID NO: 576 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 577 - protein, 334 aa, Artificial Sequence; identical to SEQ ID NO: 105
  Synthetic

SEQ ID NO: 578 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTKSKLKFSQAGASDIRDQSRNWLPGPCYRQQRVSTKDDRNNNSDFSWTGATKYHLNGRDSLVNPGPAMASHKDDDDRFFPQSGVLIFGKEGGGRGDVEIEEVMITDEEEIRTTNPVATEQYGSVSTNLQAGNAQAATADVN

SEQ ID NO: 579 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAGKTNTAVGNVMITDEEEIRTTNPVATEQYGSVSTNLQAGNAQAATADVN

SEQ ID NO: 580 - protein, 334 aa, Artificial Sequence; identical to SEQ ID NO: 73
  Synthetic

SEQ ID NO: 581 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTNTQSGLRFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 582 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 583 - protein, 334 aa, Artificial Sequence; identical to SEQ ID NO: 206
  Synthetic

SEQ ID NO: 584 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 585 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARQSGAAAGSVN

SEQ ID NO: 586 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKGRFFPQSGVLIFGKQGSEKTNVDIEKVMITDEEEIRTTNPVATEQYGSVSTNLQAGNAQAATADVN

SEQ ID NO: 587 - protein, 334 aa, Artificial Sequence; identical to SEQ ID NO: 125
  Synthetic

SEQ ID NO: 588 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 589 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 590 - protein, 334 aa, Artificial Sequence; identical to SEQ ID NO: 367
  Synthetic

SEQ ID NO: 591 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAAKDNIAIEKVMITDEEEIRTTNPVATEQYGSVSTNLQAGNAQAATADVN

SEQ ID NO: 592 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHDRNNNSNFSWTGATKYHLNGRDSLVNPGPAMASHKDDEDKFFPQSGVLIFGKEGAGRNNTAIESVMITDEEEIRTTNPVATEQYGSVSTNLQAGNAQAATADVN

SEQ ID NO: 593 - protein, 334 aa, Artificial Sequence; identical to SEQ ID NO: 365
  Synthetic

SEQ ID NO: 594 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNPTGLNTPSRLGFSQAGASDIRDQSRNWLPGPCYRQQRVSTKDDRNNNSDFSWTGATKYHLNGRDSLVNPGPAMASHKDDDDRFFPQSGVLIFGKEGSSGTNVAIDGVMITDEEEIRTTNPVATEQYGSVSTNLQAGNAQAATADVN

SEQ ID NO: 595 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQNAGKADVAVEQVMITDEEEIRTTNPVATEQYGSVSTNLQAGNAQAATADVN

SEQ ID NO: 596 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDKFFPQSGVLIFGKENGDKTNVEIDRVMITDEEEIRTTNPVATEQYGSVSTNLQAGNAQAATADVN

SEQ ID NO: 597 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSGKNNADIEKVMITDEEEIRTTNPVATEQYGSVSTNLQAGNAQAATADVN

SEQ ID NO: 598 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKEGARGADIDIGDVMITDEEEIRTTNPVATEQYGSVSTNLQAGNAQAATADVN

SEQ ID NO: 599 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGSEKTNVDIEKVMITDEEEIRTTNPVATEQYGSVSTNLQAGNAQAATADVN

SEQ ID NO: 600 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGHRATAANDDVN

SEQ ID NO: 601 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGKATISGLKFSQAGASDIRDQSRNWLPGPCYRQQRVSKTSADNNNSNFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 602 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 603 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDGRFFPQSGVLIFGKQSAKAANAAIDEVMITDEEEIRTTNPVATEQYGSVSTNLQRGNRQAATADVN

SEQ ID NO: 604 - protein, 334 aa, Artificial Sequence; identical to SEQ ID NO: 38
  Synthetic

SEQ ID NO: 605 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSATGPVTTSQLGFSQAGASDIRDQSRNWLPGPCYRQQRVSKTSTENNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 606 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAGGSTTPSRLRFSQAGASDIRDQSRNWLPGPCYRQQRVSTTPADNNNSDFSWTGATKYHLNGRDSLVNPGPAMASHRDDDDKFFPQSGVLIFGKEDGTRADVAFGDVMITDEEEIRTTNPVATEQYGSVSTNLQAGNAQAATADVN

SEQ ID NO: 607 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKEDGGGSNVEYGSVMITDEEEIRTTNPVATEQYGSVSTNLQRGNRQAATADVN

SEQ ID NO: 608 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 609 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHRDDNDKFFPQSGVLIFGKQGAKKADTDIGNVMITDEEEIRTTNPVATEQYGSVSTNLQAGNAQAATADVN

SEQ ID NO: 610 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 611 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQAGSVTQSALRFSQAGASDIRDQSRNWLPGPCYRQQRVSTQSTQNNNSEFSWTGATKYHLNGRDSLVNPGPAMASHKDDDDRFFPQSGVLIFGKQGAEATNAAFGEVMITDEEEIRTTNPVATEQYGSVSTNLQAGNAQAATADVN

SEQ ID NO: 612 - protein, 334 aa, Artificial Sequence; identical to SEQ ID NO: 312
  Synthetic

SEQ ID NO: 613 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 614 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKISADNNNSEFSWTGATKYHLNGRDSLVNPGPAMASHKDDNEKFFPQSGVLIFGKQGSGKSNVAFGDVMITDEEEIRTTNPVATEQYGSVSTNLQAGNAQAATADVN

SEQ ID NO: 615 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGAGHTTNSELLFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 616 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKAGHATQSTLMFSQAGASDIRDQSRNWLPGPCYRQQRVSTKATDNNNSNFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 617 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGTGKANIDIDKVMITDEEEIRTTNPVATEQYGSVSTNLQAGNAQAATADVN

SEQ ID NO: 618 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGSHTQSALRFSQAGASDIRDQSRNWLPGPCYRQQRVSKQSADNNNSDFSWTGATKYHLNGRDSLVNPGPAMASHKDDEEKFFPQSGVLIFGKESSGANNVEVDGVMITDEEEIRTTNPVATEQYGSVSTNLQAGNAQAATADVN

SEQ ID NO: 619 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 620 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 621 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAGKDDIAIDNVMITDEEEIRTTNPVATEQYGSVSTNLQAGNAQAATADVN

SEQ ID NO: 622 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKQPNDNNNSEFSWTGATTYHLNGRDSLVNPGPAMASHKDDNEKFFPQSGVLIFGKEGAGAANVEIDRVMITDEEEIRTTNPVATEQYGSVSTNLQAGNAQAATADVN

SEQ ID NO: 623 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPSENNNSDFSWTGATTYHLNGRDSLVNPGPAMASHRDDEDRFFPQSGVLIFGKQSAGRGDAAVDEVMITDEEEIRTTNPVATEQYGSVSTNLQAGNAQAATADVN

SEQ ID NO: 624 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQAGNAQAATADVN

SEQ ID NO: 625 - protein, 334 aa, Artificial Sequence
  Synthetic
HTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 626 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGRDPAAFEVVN

SEQ ID NO: 627 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDAGGNDVAIDKVMITDEEEIRTTNPVATEQYGSVSTNLQAGNAQAATADVN

SEQ ID NO: 628 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGAKGTDVAYDGVMITDEEEIRTTNPVATEQYGSVSTNLQAGNAQAATADVN

SEQ ID NO: 629 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATAGTVTHSRLRFSQAGASDIRDQSRNWLPGPCYRQQRVSKQASDNNNSEFSWTGATKYHLNGRDSLVNPGPAMASHKDDEEKFFPQSGVLIFGKQSGDETDVEIDRVMITDEEEIRTTNPVATEQYGSVSTNLQAGNAQAATADVN

SEQ ID NO: 630 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKQSGARDNADIDGVMITDEEEIRTTNPVATEQYGSVSTNLQAGNAQAATADVN

SEQ ID NO: 631 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 632 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 633 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGLATQSHLGFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 634 - protein, 334 aa, Artificial Sequence; identical to SEQ ID NO: 244
  Synthetic

SEQ ID NO: 635 - protein, 334 aa, Artificial Sequence; identical to SEQ ID NO: 403
  Synthetic

SEQ ID NO: 636 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNATTSRLMFSQAGASDIRDQSRNWLPGPCYRQQRVSKQSSDNNNSEFSWTGATKYHLNGRDSLVNPGPAMASHEDDNEKFFPQSGVLIFGKQGAETSNAAIDKVMITDEEEIRTTNPVATEQYGSVSTNLQAGNAQAATADVN

SEQ ID NO: 637 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGSETTSRLRFSQAGASDIRDQSRNWLPGPCYRQQRVSKTSADNNNSNFSWTGATKYHLNGRDSLVNPGPAMASHRDDEDKFFPQSGVLIFGKEGGTKNDVAIDGVMITDEEEIRTTNPVATEQYGSVSTNLQAGNAQAATADVN

SEQ ID NO: 638 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKENASKGNADVDSVMITDEEEIRTTNPVATEQYGSVSTNLQAGNAQAATADVN

SEQ ID NO: 639 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADRFFPQSGVLIFGKQGSEKTNVDIEKVMITDEEEIRTTNPVATEQYGSVSTNLQAGNAQAATADVN

SEQ ID NO: 640 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGGSRTNAAVGDVMITDEEEIRTTNPVATEQYGSVSTNLQAGNAQAATADVN

SEQ ID NO: 641 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKGKFFPQSGVLIFGKQGSEKTNVDIEKVMITDEEEIRTTNPVATEQYGSVSTNLQRGNRQAATADVN

SEQ ID NO: 642 - protein, 334 aa, Artificial Sequence; identical to SEQ ID NO: 302
  Synthetic

SEQ ID NO: 643 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 644 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEEKFFPQSGVLIFGKQSAEKTNAAIGHVMITDEEEIRTTNPVATEQYGSVSTNLQAGNAQAATADVN

SEQ ID NO: 645 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKQPTGNNNSNFSWTGATKYHLNGRDSLVNPGPAMASHEDDAGRFFPQSGVLIFGKESAGKTNVAIGEVMITDEEEIRTTNPVATEQYGSVSTNLQAGNAQAATADVN

SEQ ID NO: 646 - protein, 334 aa, Artificial Sequence; identical to SEQ ID NO: 506
  Synthetic

SEQ ID NO: 647 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 648 - protein, 334 aa, Artificial Sequence; identical to SEQ ID NO: 509
  Synthetic

SEQ ID NO: 649 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKHGGNNNSNFSWTGATTYHLNGRDSLVNPGPAMASHRDDEDKFFPQSGVLIFGKEGTDGNDADIENVMITDEEEIRTTNPVATEQYGSVSTNLQAGNAQAATADVN

SEQ ID NO: 650 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGRFFPQSGVLIFGKEDAGKTNIDIGQVMITDEEEIRTTNPVATEQYGSVSTNLQAGNAQAATADVN

SEQ ID NO: 651 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGLTTLSQLGFSQAGASDIRDQSRNWLPGPCYRQQRVSKQPSQNNNSNFSWTGATKYHLNGRDSLVNPGPAMASHEDDNGRFFPQSGVLIFGKQGSEKTNVDIEKVMITDEEEIRTTNPVATEQYGSVSTNLQAGNAQAATADVN

SEQ ID NO: 652 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 653 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASGGSITTSRLRFSQAGASDIRDQSRNWLPGPCYRQQRVSTKDDRNNNSDFSWTGATKYHLNGRDSLVNPGPAMASHKDDDDRFFPQSGVLIFGKQGGGGADAAIGEVMITDEEEIRTTNPVATEQYGSVSTNLQAGNAQAATADVN

SEQ ID NO: 654 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGRFFPQSGVLIFGKESGGANDIDIERVMITDEEEIRTTNPVATEQYGSVSTNLQAGNAQAATADVN

SEQ ID NO: 655 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSGKTDAEIDSVMITDEEEIRTTNPVATEQYGSVSTNLQAGNAQAATADVN

SEQ ID NO: 656 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSADNNNSNFSWTGATKYHLNGRDSLVNPGPAMASHRDDEDKFFPQSGVLIFGKEGTGGNDAEIDDVMITDEEEIRTTNPVATEQYGSVSTNLQAGNAQAATADVN

SEQ ID NO: 657 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKDKFFPQSGVLIFGKQGSEKTNVDIEKVMITDEEEIRTTNPVATEQYGSVSTNLQAGNAQAATADVN

SEQ ID NO: 658 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGHNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 659 - protein, 334 aa, Artificial Sequence; identical to SEQ ID NO: 98
  Synthetic

SEQ ID NO: 660 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPTRNNNSEFSWTGATKYHLNGRDSLVNPGPAMASHGDDEGRFFPQSGVLIFGKQGASETNVEIDKVMITDEEEIRTTNPVATEQYGSVSTNLQAGNAQAATADVN

SEQ ID NO: 661 - protein, 334 aa, Artificial Sequence; identical to SEQ ID NO: 86
  Synthetic

SEQ ID NO: 662 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHAGSKTTSELKFSQAGASDIRDQSRNWLPGPCYRQQRVSKTDGENNNSNFSWTGATTYHLNGRDSLVNPGPAMASHKDDEEKFFPQSGVLIFGKENASGTNVDIGNVMITDEEEIRTTNPVATEQYGSVSTNLQAGNAQAATADVN

SEQ ID NO: 663 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAATGNTTPSPLRFSQAGASDIRDQSRNWLPGPCYRQQRVSKPPNGNNNSEFSWTGATTYHLNGRDSLVNPGPAMASHKDDDDRFFPQSGVLIFGKQGAEGTNVAYDKVMITDEEEIRTTNPVATEQYGSVSTNLQAGNAQAATADVN

SEQ ID NO: 664 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGSPTKSRLGFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 665 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSAASNADVGQVMITDEEEIRTTNPVATEQYGSVSTNLQAGNAQAATADVN

SEQ ID NO: 666 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDDRFFPQSGVLIFGKQGSEKTNVDIEKVMITDEEEIRTTNPVATEQYGSVSTNLQAGNAQAATADVN

SEQ ID NO: 667 - protein, 334 aa, Artificial Sequence; identical to SEQ ID NO: 93
  Synthetic

SEQ ID NO: 668 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSTAGTQTHSQLLFSQAGASDIRDQSRNWLPGPCYRQQRVSTTPADNNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 669 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGGTTYHLNGRDSLVNPGPAMASHKDDEGRFFPQSGVLIFGKENAGGDNVEIERVMITDEEEIRTTNPVATEQYGSVSTNLQAGNAQAATADVN

SEQ ID NO: 670 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 671 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQGGLHTLSGLRFSQAGASDIRDQSRNWLPGPCYRQQRVSKKPDQNNNSEFSWTGATKYHLNGRDSLVNPGPAMASHKDDEEKFFPQSGVLIFGKENSSAGDVDIEKVMITDEEEIRTTNPVATEQYGSVSTNLQAGNAQAATADVN

SEQ ID NO: 672 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 673 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRAPAATTNVE

SEQ ID NO: 674 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARATAADTEVH

SEQ ID NO: 675 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 676 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRHGGAASEGVE

SEQ ID NO: 677 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENTTGNNVDIDRVMITDEEEIRTTNPVATEQYGSVSTNLQAGNAQAATADVN

SEQ ID NO: 678 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTNTRAAFQMVE

SEQ ID NO: 679 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGATNAAIGSVMITDEEEIRTTNPVATEQYGSVSTNLQAGNAQAATADVN

SEQ ID NO: 680 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHVTQSRLLFSQAGASDIRDQSRNWLPGPCYRQQRVSKQPAGNNNSEFSWTGATKYHLNGRDSLVNPGPAMASHGDDKDKFFPQSGVLIFGKQNATGNDVEIEHVMITDEEEIRTTNPVATEQYGSVSTNLQAGNAQAATADVN

SEQ ID NO: 681 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRTGAAVRDVH

SEQ ID NO: 682 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNATGRDTMSTLKFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 683 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTDGENNNSDFSWTGATKYHLNGRDSLVNPGPAMASHKDDEEKFFPQSGVLIFGKQNGGKNDVDIEQVMITDEEEIRTTNPVATEQYGSVSTNLQAGNAQAATADVN

SEQ ID NO: 684 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGIQTTSKLRFSQAGASDIRDQSRNWLPGPCYRQQRVSKQSDHNNNSNFSWTGATKYHLNGRDSLVNPGPAMASHKDDDDKFFPQSGVLIFGKEGGAGADVDIGQVMITDEEEIRTTNPVATEQYGSVSTNLQAGNAQAATADVN

SEQ ID NO: 685 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDANRFFPQSGVLIFGKQGSEKTNVDIENVMITDEEEIRTTNPVATEQYGSVSTNLQAGNAQAATADVN

SEQ ID NO: 686 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTSGSHTMSDLQFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 687 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 688 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDGRFFPQSGVLIFGKQGADAGDVAVEQVMITDEEEIRTTNPVATEQYGSVSTNLQAGNAQAATADVN

SEQ ID NO: 689 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAGNNNSDFSWTGATKYHLNGRDSLVNPGPAMASHEDDADKFFPQSGVLIFGKQGSSGSDVDFDNVMITDEEEIRTTNPVATEQYGSVSTNLQAGNAQAATADVN

SEQ ID NO: 690 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTSGLKTTSHLGFSQAGASDIRDQSRNWLPGPCYRQQRVSKTSADNNNSEYSWTGATKYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 691 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAETGTATTSRLKFSQAGASDIRDQSRNWLPGPCYRQQRVSKVSADNNNSEFSWTGATKYHLNGRDSLVNPGPAMASHRDDEDKFFPQSGVLIFGKENTGAGDADVDRVMITDEEEIRTTNPVATEQYGSVSTNLQRGNRQAATADVN

SEQ ID NO: 692 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQGSEKTNVDIEKVMITDEEEIRTTNPVATEQYGSVSTNLQRGNRQAATADVN

SEQ ID NO: 693 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPRSPAAFDSVT

SEQ ID NO: 694 - protein, 334 aa, Artificial Sequence; identical to SEQ ID NO: 75
  Synthetic

SEQ ID NO: 695 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQDTSANDTDIDGVMITDEEEIRTTNPVATEQYGSVSTNLQAGNAQAATADVN

SEQ ID NO: 696 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNGSASNVAIDNVMITDEEEIRTTNPVATEQYGSVSTNLQAGNAQAATADVN

SEQ ID NO: 697 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQGSEKTNVDIEKVMITDEEEIRTTNPVATEQYGSVSTNLQAGNAQAATADVN

SEQ ID NO: 698 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 699 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNARTAAATKEVQ

SEQ ID NO: 700 - protein, 334 aa, Artificial Sequence
  Synthetic
ESGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQPTGNNNSEFSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 701 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGSITTSGLMFSQAGASDIRDQSRNWLPGPCYRQQRVSKTDGENNNSDFSWTGATKYHLNGRDSLVNPGPAMASHKDDEEKFFPQSGVLIFGKQDTSANDTDIDGVMITDEEEIRTTNPVATEQYGSVSTNLQAGNAQAATADVN

SEQ ID NO: 702 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSHRDGAASDNVE

SEQ ID NO: 703 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKQDTDNNNSDFSWTGATKYHLNGRDSLVNPGPAMASHKDDDDRFFPQSGVLIFGKQGSGKSNVAFGDVMITDEEEIRTTNPVATEQYGSVSTNLQAGNAQAATADVN

SEQ ID NO: 704 - protein, 334 aa, Artificial Sequence; identical to SEQ ID NO: 510
  Synthetic

SEQ ID NO: 705 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQGAGATNAAIGSVMITDEEEIRTTNPVATEQYGSVSTNLQAGNAQAATADVN

SEQ ID NO: 706 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGRTTMSGLRFSQAGASDIRDQSRNWLPGPCYRQQRVSKPPNGNNNSEFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 707 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKGGSTTHSNLGFSQAGASDIRDQSRNWLPGPCYRQQRVSKQPNENNNSEFSWPGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 708 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 709 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSGKNNADIEKVMITDEEEIRTTNPVATEQYGSVSTNLQAGNAQAATADVN

SEQ ID NO: 710 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAGGRVTLSKLRFSQAGASDIRDQSRNWLPGPCYRQQRVSTKDDRNNNSDFSWTGATKYHLNGRDSLVNPGPAMASHKDDDDRFFPQSGVLIFGKQGAGTTDVEYGQVMITDEEEIRTTNPVATEQYGSVSTNLQAGNAQAATADVN

SEQ ID NO: 711 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPRGPAAVTGVH

SEQ ID NO: 712 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDEDKFFPQSGVLIFGKQGSEKTNVDIEKVMITDEEEIRTTNPVATEQYGSVSTNLQAGNAQAATADVN

SEQ ID NO: 713 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNSGNHTLSPLSFSQAGASDIRDQSRNWLPGPCYRQQRVSKTSADNNNSEYSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 714 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 715 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDKFFPQSGVLIFGKQGSEKTNVDIEKVMITDEEEIRTTNPVATEQYGSVSTNLQAGNAQAATADVN

SEQ ID NO: 716 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGSVTQSHLRFSQAGASDIRDQSRNWLPGPCYRQQRVSKQSGDNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 717 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKQGATRSNIDIGNVMITDEEEIRTTNPVATEQYGSVSTNLQAGNAQAATADVN

SEQ ID NO: 718 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDEKFFPQSGVLIFGKQNTSTSDVEIDGVMITDEEEIRTTNPVATEQYGSVSTNLQRGNRQAATADVN

SEQ ID NO: 719 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGSVTKSHLMFSQAGASDIRDQSRNWLPGPCYRQQRVSKTSADNNNSEYSWTGATKYHLNGRDSLVNPGPAMASHKDDEEKFFPQSGVLIFGKEDSGRTNIDIDNVMITDEEEIRTTNPVATEQYGSVSTNLQAGNAQAATADVN

SEQ ID NO: 720 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSTTPTGNNNSDFSWTGATKYHLNGRDSLVNPGPAMASHKDDDDRFFPQSGVLIFGKESSDGNNVAIDGVMITDEEEIRTTNPVATEQYGSVSTNLQAGNAQAATADVN

SEQ ID NO: 721 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQSGQNNNSDFSWTGATKYHLNGRDSLVNPGPAMASHKDDEGKFFPQSGVLIFGKQSGEKNDVDIDGVMITDEEEIRTTNPVATEQYGSVSTNLQAGNAQAATADVN

SEQ ID NO: 722 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTQRSGAAITDVE

SEQ ID NO: 723 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDERFFPQSGVLIFGKENGKAGDVDIGNVMITDEEEIRTTNPVATEQYGSVSTNLQAGNAQAATADVN

SEQ ID NO: 724 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKENGDKSNTAIDRVMITDEEEIRTTNPVATEQYGSVSTNLQAGNAQAATADVN

SEQ ID NO: 725 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKEDAGTTNAAIEHVMITDEEEIRTTNPVATEQYGSVSTNLQAGNAQAATADVN

SEQ ID NO: 726 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 727 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQNTGGGNVDIEHVMITDEEEIRTTNPVATEQYGSVSTNLQAGNAQAATADVN

SEQ ID NO: 728 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQRNPAASDVVH

SEQ ID NO: 729 - protein, 334 aa, Artificial Sequence; identical to SEQ ID NO: 344
  Synthetic

SEQ ID NO: 730 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSGGNNNSNFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 731 - protein, 334 aa, Artificial Sequence; identical to SEQ ID NO: 446
  Synthetic

SEQ ID NO: 732 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPTGNNNSDFSWTGATKYHLNGRDSLVNPGPAMASHKDDDDRFFPQSGVLIFGKQDASKNNVDVGGVMITDEEEIRTTNPVATEQYGSVSTNLQAGNAQAATADVN

SEQ ID NO: 733 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSELRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 734 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHKDDADKFFPQSGVLIFGKQDSRGNNIAYDEVMITDEEEIRTTNPVATEQYGSVSTNLQAGNAQAATADVN

SEQ ID NO: 735 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRSGGAAFSRVD

SEQ ID NO: 736 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHRDDDGKFFPQSGVLIFGKQNAGKSNIAFGNVMITDEEEIRTTNPVATEQYGSVSTNLQAGNAQAATADVN

SEQ ID NO: 737 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 738 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDTDNNNSNFSWTGATTYHLNGRDSLVNPGPAMASHGDDAERFFPQSGVLIFGKQGSEKTNVDIEKVMITDEEEIRTTNPVATEQYGSVSTNLQAGNAQAATADVN

SEQ ID NO: 739 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARNNPAAYRNVD

SEQ ID NO: 740 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 741 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 742 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKQSSDNNNSEFSWTGATKYHLNGRDSLVNPGPAMASHKDDTGKFFPQSGVLIFGKQGSEKTNVDIEKVMITDEEEIRTTNPVATEQYGSVSTNLQAGNAQAATADVN

SEQ ID NO: 743 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGTLTHSELSFSQAGASDIRDQSRNWLPGPCYRQQRVSKQASDNNNSNFSWTGATTYHLNGRDSLVNPGPAMASHRDDDDKFFPQSGVLIFGKQSASKNNIAIEEVMITDEEEIRTTNPVATEQYGSVSTNLQAGNAQAATADVN

SEQ ID NO: 744 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTDKFFPQSGVLIFGKQSASKNNIAIEEVMITDEEEIRTTNPVATEQYGSVSTNLQAGNAQAATADVN

SEQ ID NO: 745 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSRKGNVDIEEVMITDEEEIRTTNPVATEQYGSVSTNLQAGNAQAATADVN

SEQ ID NO: 746 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGHHTLSDLRFSQAGASDIRDQSRNWLPGPCYRQQRVSKVSADNNNSEFSWTGATKYHLNGRDSLVNPGPAMASHKDDEEKFFPQSGVLIFGKQSATKNNIAIEHVMITDEEEIRTTNPVATEQYGSVSTNLQAGNAQAATADVN

SEQ ID NO: 747 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGSVTKSHLMFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 748 - protein, 334 aa, Artificial Sequence; identical to SEQ ID NO: 435
  Synthetic

SEQ ID NO: 749 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWPGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 750 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGAGKGNVEIGEVMITDEEEIRTTNPVATEQYGSVSTNLQAGNAQAATADVN

SEQ ID NO: 751 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPKNKAATGTVH

SEQ ID NO: 752 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 753 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 754 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRSDNAASAEVH

SEQ ID NO: 755 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTQRGAAAIDTVD

SEQ ID NO: 756 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 757 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAGKTDVAIGRVMITDEEEIRTTNPVATEQYGSVSTNLQAGNAQAATADVN

SEQ ID NO: 758 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 759 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 760 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSKTSADNNNSEYSWTGATKYHLNGRDSLVNPGPAMASHKDDEEKFFPQSGVLIFGKQGAAKNNVAVEHVMITDEEEIRTTNPVATEQYGSVSTNLQAGNAQAATADVN

SEQ ID NO: 761 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKGGSTTHSKLGFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 762 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKEDTGADNVDIDSVMITDEEEIRTTNPVATEQYGSVSTNLQAGNAQAATADVN

SEQ ID NO: 763 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESGNKNNADIGSVMITDEEEIRTTNPVATEQYGSVSTNLQAGNAQAATADVN

SEQ ID NO: 764 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQTGRNTTSDLRFSQAGASDIRDQSRNWLPGPCYRQQRVSTKSTDNNNSDFSWTGATTYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 765 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 766 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAAGNITLSKLNFSQAGASDIRDQSRNWLPGPCYRQQRVSKTAADNNNSDFSWTGATKYHLNGRDSLVNPGPAMASHKDDDGKFFPQSGVLIFGKQDAGKANIDIDGVMITDEEEIRTTNPVATEQYGSVSTNLQAGNAQAATADVN

SEQ ID NO: 767 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGHITPSQLQFSQAGASDIRDQSRNWLPGPCYRQQRVSKTSADNNNSNFSWTGATKYHLNGRDSLVNPGPAMASHKDDEDKFFPQSGVLIFGKQSARGTDVAVDDVMITDEEEIRTTNPVATEQYGSVSTNLQAGNAQAATADVN

SEQ ID NO: 768 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPTGNNNSDFSWTGATKYHLNGRDSLVNPGPAMASHKDDDDRFFPQSGVLIFGKEGSGKSDAAIGDVMITDEEEIRTTNPVATEQYGSVSTNLQAGNAQAATADVN

SEQ ID NO: 769 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGRMTLSTLEFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 770 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKQPNDNNNSEFSWTGATTYHLNGRDSLVNPGPAMASHKDDNDRFFPQSGVLIFGKQGAGRSDIDIGNVMITDEEEIRTTNPVATEQYGSVSTNLQAGNAQAATADVN

SEQ ID NO: 771 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTRGDAATAKVQ

SEQ ID NO: 772 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNTRSGAAAKDVH

SEQ ID NO: 773 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSARTTAASSMVA

SEQ ID NO: 774 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNAGPKTNSALSFSQAGASDIRDQSRNWLPGPCYRQQRVSKTDGENNNSDFSWTGATKYHLNGRDSLVNPGPAMASHKDDEEKFFPQSGVLIFGKEDGGGGNVAIEQVMITDEEEIRTTNPVATEQYGSVSTNLQAGNAQAATADVN

SEQ ID NO: 775 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 776 - protein, 334 aa, Artificial Sequence; identical to SEQ ID NO: 317
  Synthetic

SEQ ID NO: 777 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSPRDGAAVGAVK

SEQ ID NO: 778 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDDDNNNSDFSWTGATKYHLNGRDSLVNPGPAMASHRDDEDKFFPQSGVLIFGKESAGRNDIAIDQVMITDEEEIRTTNPVATEQYGSVSTNLQAGNAQAATADVN

SEQ ID NO: 779 - protein, 334 aa, Artificial Sequence; identical to SEQ ID NO: 438
  Synthetic

SEQ ID NO: 780 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 781 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPSGSTTMSTLRFSQAGASDIRDQSRNWLPGPCYRQQRVSKRPTDNNNSEFSWPGATTYHLNGRDSLVNPGPAMASHKDDNDKFFPQSGVLIFGKQGAEGTNVAYDKVMITDEEEIRTTNPVATEQYGSVSTNLQAGNAQAATADVN

SEQ ID NO: 782 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHVTQSRLLFSQAGASDIRDQSRNWLPGPCYRQQRVSKQSDRNNNSEFSWTGATKYHLNGRDSLVNPGPAMASHKDDDDRFFPQSGVLIFGKQGARGADAEIESVMITDEEEIRTTNPVATEQYGSVSTNLQAGNAQAATADVN

SEQ ID NO: 783 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNATTSRLMFSQAGASDIRDQSRNWLPGPCYRQQRVSKTSADNNNSEYSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 784 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRTGTATNSGLSFSQAGASDIRDQSRNWLPGPCYRQQRVSKQSSGNNNSNFSWTGATKYHLNGRDSLVNPGPAMASHRDDDDKFFPQSGVLIFGKEGATATDADVDQVMITDEEEIRTTNPVATEQYGSVSTNLQAGNAQAATADVN

SEQ ID NO: 785 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRTGLATLSGLKFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 786 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKEGGTANNVAVDKVMITDEEEIRTTNPVATEQYGSVSTNLQAGNAQAATADVN

SEQ ID NO: 787 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTGTTDAAVDDVMITDEEEIRTTNPVATEQYGSVSTNLQAGNAQAATADVN

SEQ ID NO: 788 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSAGRVTLSALRFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 789 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 790 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDTSGADVDIDEVMITDEEEIRTTNPVATEQYGSVSTNLQAGNAQAATADVN

SEQ ID NO: 791 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQNGSASNVAIDNVMITDEEEIRTTNPVATEQYGSVSTNLQAGNAQAATADVN

SEQ ID NO: 792 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKQDTDNNNSDFSWTGATKYHLNGRDSLVNPGPAMASHKDDDDRFFPQSGVLIFGKQGSGKSNVAFGDVMITDEEEIRTTNPVATEQYGSVSTNLQAGNAQAATADVN

SEQ ID NO: 793 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAGTNDIDIERVMITDEEEIRTTNPVATEQYGSVSTNLQAGNAQAATADVN

SEQ ID NO: 794 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTSGTTTKSALRFSQAGASDIRDQSRNWLPGPCYRQQRVSTKDTDNNNSNFSWTGATKYHLNGRDSLVNPGPAMASHKDDDDRFFPQSGVLIFGKENGEASDVEIGQVMITDEEEIRTTNPVATEQYGSVSTNLQAGNAQAATADVN

SEQ ID NO: 795 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKEGTGTTNVAVESVMITDEEEIRTTNPVATEQYGSVSTNLQAGNAQAATADVN

SEQ ID NO: 796 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATTYHLNGRDSLVNPGPAMASHKDDDDRFFPQSGVLIFGKQGGAKANVDVEHVMITDEEEIRTTNPVATEQYGSVSTNLQAGNAQAATADVN

SEQ ID NO: 797 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 798 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKRPTDNNNSDFSWTGATKYHLNGRDSLVNPGPAMASHKDDDDKFFPQSGVLIFGKQGAGATNAAIGSVMITDEEEIRTTNPVATEQYGSVSTNLQAGNAQAATADVN

SEQ ID NO: 799 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 800 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGNTTTSPLLFSQAGASDIRDQSRNWLPGPCYRQQRVSKTDGENNNSDFSWTGATKYHLNGRDSLVNPGPAMASHKDDEEKFFPQSGVLIFGKQGSAKSDVEVGGVMITDEEEIRTTNPVATEQYGSVSTNLQRGNRQAATADVN

SEQ ID NO: 801 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGHETLSRLMFSQAGASDIRDQSRNWLPGPCYRQQRVSKQDADNNNSNFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 802 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATTYHLNGRDSLVNPGPAMASHKDDNEKFFPQSGVLIFGKQGAGGTNVDDDQVMITDEEEIRTTNPVATEQYGSVSTNLQAGNAQAATADVN

SEQ ID NO: 803 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRTAAASRVVE

SEQ ID NO: 804 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGKFFPQSGVLIFGKQSAETGNADIGQVMITDEEEIRTTNPVATEQYGSVSTNLQAGNAQAATADVN

SEQ ID NO: 805 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNDPAAFTVVE

SEQ ID NO: 806 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTDDDNNNSDFSWTGATKYHLNGRDSLVNPGPAMASHRDDEDKFFPQSGVLIFGKESAGKTNTEYDKVMITDEEEIRTTNPVATEQYGSVSTNLQAGNAQAATADVN

SEQ ID NO: 807 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTARTPAADSAVE

SEQ ID NO: 808 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGSTRSNAEIGSVMITDEEEIRTTNPVATEQYGSVSTNLQAGNAQAATADVN

SEQ ID NO: 809 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNTRSGAASSSVD

SEQ ID NO: 810 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTATNSRLRFSQAGASDIRDQSRNWLPGPCYRQQRVSKKYTDNNNSNFSWTGATTYHLNGRDSLVNPGPAMASHRDDEDKFFPQSGVLIFGKQGSGKDNVEVGQVMITDEEEIRTTNPVATEQYGSVSTNLQAGNAQAATADVN

SEQ ID NO: 811 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDAGRFFPQSGVLIFGKQNAGKNDTDIDGVMITDEEEIRTTNPVATEQYGSVSTNLQAGNAQAATADVN

SEQ ID NO: 812 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGRVTISNLRFSQAGASDIRDQSRNWLPGPCYRQQRVSKTSADNNNSNFSWTGATKYHLNGRDSLVNPGPAMASHRDDEDKFFPQSGVLIFGKQDASGDDVEVDKVMITDEEEIRTTNPVATEQYGSVSTNLQAGNAQAATADVN

SEQ ID NO: 813 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 814 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGPNTPSALRFSQAGASDIRDQSRNWLPGPCYRQQRVSKPPNGNNNSEFSWTGATTYHLNGRDSLVNPGPAMASHKDDDDRFFPQSGVLIFGKQGSGRSNIEFEKVMITDEEEIRTTNPVATEQYGSVSTNLQAGNAQAATADVN

SEQ ID NO: 815 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGPATKSALGFSQAGASDIRDQSRNWLPGPCYRQQRVSKTDGENNNSDFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 816 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGTLTTSNLRFSQAGASDIRDQSRNWLPGPCYRQQRVSTTSNENNNSDFSWTGATKYHLNGRDSLVNPGPAMASHKDDDDRFFPQSGVLIFGKQGAKGSNAAYDSVMITDEEEIRTTNPVATEQYGSVSTNLQAGNAQAATADVN

SEQ ID NO: 817 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHEDDNEKFFPQSGVLIFGKEGTRKNNVDIEQVMITDEEEIRTTNPVATEQYGSVSTNLQAGNAQAATADVN

SEQ ID NO: 818 - protein, 334 aa, Artificial Sequence; identical to SEQ ID NO: 60
  Synthetic

SEQ ID NO: 819 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 820 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGKTPAAVQGVE

SEQ ID NO: 821 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSERGNAASKTVN

SEQ ID NO: 822 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEGSGGGNVEFEGVMITDEEEIRTTNPVATEQYGSVSTNLQAGNAQAATADVN

SEQ ID NO: 823 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGSTTLSGLRFSQAGASDIRDQSRNWLPGPCYRQQRVSKTSADNNNSEFSWPGATKYHLNGRDSLVNPGPAMASHRDDEEKFFPQSGVLIFGKQNAAENDVDIGEVMITDEEEIRTTNPVATEQYGSVSTNLQAGNAQAATADVN

SEQ ID NO: 824 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHNTKSGLEFSQAGASDIRDQSRNWLPGPCYRQQRVSKTAADNNNSDFSWTGATKYHLNGRDSLVNPGPAMASHKDDDGKFFPQSGVLIFGKEGATRANVAIDEVMITDEEEIRTTNPVATEQYGSVSTNLQAGNAQAATADVN

SEQ ID NO: 825 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQSGLNTLSDLRFSQAGASDIRDQSRNWLPGPCYRQQRVSKQSSDNNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 826 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNDTGIPTTSRLKFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 827 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNRTTAAFTGVA

SEQ ID NO: 828 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDRFFPQSGVLIFGKQGSGKSNVAFGDVMITDEEEIRTTNPVATEQYGSVSTNLQAGNAQAATADVN

SEQ ID NO: 829 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 830 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGPATKSGLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 831 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGNHTISQLGFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 832 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRSATAASNEVQ

SEQ ID NO: 833 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSGSGIKTKSDLRFSQAGASDIRDQSRNWLPGPCYRQQRVSKKPDQNNNSDFSWTGATKYHLNGRDSLVNPGPAMASHKDDDEKFFPQSGVLIFGKQNATGTNVDVGSVMITDEEEIRTTNPVATEQYGSVSTNLQAGNAQAATADVN

SEQ ID NO: 834 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 835 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGGRRANVEIDQVMITDEEEIRTTNPVATEQYGSVSTNLQAGNAQAATADVN

SEQ ID NO: 836 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSNFSWTGATKYHLNGRDSLVNPGPAMASHKDDNEKFFPQSGVLIFGKEGGNGSNVDIGRVMITDEEEIRTTNPVATEQYGSVSTNLQAGNAQAATADVN

SEQ ID NO: 837 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 838 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRGGHTTLSELGFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 839 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEERNTAASATVE

SEQ ID NO: 840 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPTGNNNSNFSWTGATKYHLNGRDSLVNPGPAMASHKDDDDRFFPQSGVLIFGKEGGNGTDVEIDSVMITDEEEIRTTNPVATEQYGSVSTNLQAGNAQAATADVN

SEQ ID NO: 841 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKQGGGKTNIDIGHVMITDEEEIRTTNPVATEQYGSVSTNLQAGNAQAATADVN

SEQ ID NO: 842 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDAAGIKTTSQLNFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 843 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTSADNNNSEYSWTGATTYHLNGRDSLVNPGPAMASHKDDEEKFFPQSGVLIFGKQGSDTNNVEIDRVMITDEEEIRTTNPVATEQYGSVSTNLQAGNAQAATADVN

SEQ ID NO: 844 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGPTTLSRLGFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 845 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKTPDGNNNSNFSWTGATKYHLNGRDSLVNPGPAMASHKDDEDRFFPQSGVLIFGKQGSEKTNVDIEKVMITDEEEIRTTNPVATEQYGSVSTNLQAGNAQAATADVN

SEQ ID NO: 846 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 847 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKQSDRNNNSEFSWTGATKYHLNGRDSLVNPGPAMASHKDDEDKFFPQSGVLIFGKQDGGGSNVDIEGVMITDEEEIRTTNPVATEQYGSVSTNLQAGNAQAATADVN

SEQ ID NO: 848 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGETGIATHSNLHFSQAGASDIRDQSRNWLPGPCYRQQRVSKQPGDNNNSNFSWTGATKYHLNGRDSLVNPGPAMASHKDDDDRFFPQSGVLIFGKEGAAGSDVEIGGVMITDEEEIRTTNPVATEQYGSVSTNLQAGNAQAATADVN

SEQ ID NO: 849 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTGKFFPQSGVLIFGKQDSTGNNIDIEQVMITDEEEIRTTNPVATEQYGSVSTNLQAGNAQAATADVN

SEQ ID NO: 850 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 851 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDRFFPQSGVLIFGKEGAGKTDVAIGRVMITDEEEIRTTNPVATEQYGSVSTNLQAGNAQAATADVN

SEQ ID NO: 852 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGHKTTSNLGFSQAGASDIRDQSRNWLPGPCYRQQRVSKQHNQNNNSEFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 853 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSTTPADNNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 854 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHRDDDEKFFPQSGVLIFGKQSAKAANAAIDEVMITDEEEIRTTNPVATEQYGSVSTNLQAGNAQAATADVN

SEQ ID NO: 855 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQNADRNNVEIGEVMITDEEEIRTTNPVATEQYGSVSTNLQAGNAQAATADVN

SEQ ID NO: 856 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 857 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGPLTMSALRFSQAGASDIRDQSRNWLPGPCYRQQRVSKTSADNNNSEYSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 858 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKTDGENNNSDFSWTGATKYHLNGRDSLVNPGPAMASHKDDDDRFFPQSGVLIFGKQNSSGNDIEIDQVMITDEEEIRTTNPVATEQYGSVSTNLQAGNAQAATADVN

SEQ ID NO: 859 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSGRNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 860 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDARKTNAEYERVMITDEEEIRTTNPVATEQYGSVSTNLQAGNAQAATADVN

SEQ ID NO: 861 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGTNTLSRLLFSQAGASDIRDQSRNWLPGPCYRQQRVSKKYTDNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 862 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKNKGPAAAHEVH

SEQ ID NO: 863 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPDGNNNSNFSWTGATKYHLNGRDSLVNPGPAMASHKDDEDRFFPQSGVLIFGKEGSGKSDAAIGDVMITDEEEIRTTNPVATEQYGSVSTNLQAGNAQAATADVN

SEQ ID NO: 864 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRSGSKTNSTLSFSQAGASDIRDQSRNWLPGPCYRQQRVSKQSDDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 865 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 866 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKQPGDNNNSDFSWTGATKYHLNGRDSLVNPGPAMASHKDDEEKFFPQSGVLIFGKQGSEKTNVDIEKVMITDEEEIRTTNPVATEQYGSVSTNLQGTRDGAAAEDVA

SEQ ID NO: 867 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKDSRNNNSDFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 868 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGSTRSDVAFDDVMITDEEEIRTTNPVATEQYGSVSTNLQAGNAQAATADVN

SEQ ID NO: 869 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKGGNITNSELRFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 870 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDDDRFFPQSGVLIFGKESSSATNIDIDRVMITDEEEIRTTNPVATEQYGSVSTNLQAGNAQAATADVN

SEQ ID NO: 871 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGTITKSNLMFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 872 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASTGINTLSTLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 873 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKQSGQNNNSDFSWTGATKYHLNGRDSLVNPGPAMASHKDDEGKFFPQSGVLIFGKQDGEGANIEFDRVMITDEEEIRTTNPVATEQYGSVSTNLQAGNAQAATADVN

SEQ ID NO: 874 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTDRFFPQSGVLIFGKEGAGGNNVEIDDVMITDEEEIRTTNPVATEQYGSVSTNLQRGNRQAATADVN

SEQ ID NO: 875 - protein, 334 aa, Artificial Sequence; identical to SEQ ID NO: 386
  Synthetic

SEQ ID NO: 876 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKHNDRAATAGVA

SEQ ID NO: 877 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGESGLQTNSTLRFSQAGASDIRDQSRNWLPGPCYRQQRVSKQDAENNNSEFSWPGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 878 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNDTTSNLGFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQRGNRQAATADVN

SEQ ID NO: 879 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQDHRNPAADQAVN

SEQ ID NO: 880 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 881 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGTAGNNVAIENVMITDEEEIRTTNPVATEQYGSVSTNLQAGNAQAATADVN

SEQ ID NO: 882 - protein, 334 aa, Artificial Sequence; identical to SEQ ID NO: 356
  Synthetic

SEQ ID NO: 883 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRSADAADTSVH

SEQ ID NO: 884 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAGGTLTHSRLKFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 885 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 886 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARGPAADAIVE

SEQ ID NO: 887 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENAGGDNVEIERVMITDEEEIRTTNPVATEQYGSVSTNLQAGNAQAATADVN

SEQ ID NO: 888 - protein, 334 aa, Artificial Sequence; identical to SEQ ID NO: 274
  Synthetic

SEQ ID NO: 889 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGRMTMSKLQFSQAGASDIRDQSRNWLPGPCYRQQRVSKTDGENNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 890 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRRSHAASAGVD

SEQ ID NO: 891 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 892 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 893 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAESGTATTSRLRFSQAGASDIRDQSRNWLPGPCYRQQRVSKQPNDNNNSEFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 894 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNREFSWTGATTYHLNGRDSLVNPGPAMASHKDDDDRFFPQSGVLIFGKEGSAGSNTEFDQVMITDEEEIRTTNPVATEQYGSVSTNLQRGNRQAATADVN

SEQ ID NO: 895 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPDDNNNSDFSWTGATKYHLNGRDSLVNPGPAMASHKDDDDRFFPQSGVLIFGKEDSTTGDADIEGVMITDEEEIRTTNPVATEQYGSVSTNLQAGNAQAATADVN

SEQ ID NO: 896 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARAGIETQSRLLFSQAGASDIRDQSRNWLPGPCYRQQRVSKQSDRNNNSEFSWTGATKYHLNGRDSLVNPGPAMASHKDDEDKFFPQSGVLIFGKQNGGGNNVEIDGVMITDEEEIRTTNPVATEQYGSVSTNLQAGNAQAATADVN

SEQ ID NO: 897 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGIMTLSELRFSQAGASDIRDQSRNWLPGPCYRQQRVSTTPADNNNSDFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 898 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHRDDTDRFFPQSGVLIFGKQDAGKSNADIDRVMITDEEEIRTTNPVATEQYGSVSTNLQAGNAQAATADVN

SEQ ID NO: 899 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGATGDNVEVEQVMITDEEEIRTTNPVATEQYGSVSTNLQAGNAQAATADVN

SEQ ID NO: 900 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAAGSDVDIEKVMITDEEEIRTTNPVATEQYGSVSTNLQAGNAQAATADVN

SEQ ID NO: 901 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSTTPADNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 902 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNPGGRETHSALRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 903 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTKSNENNNSDFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 904 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSDRGAAASQEVE

SEQ ID NO: 905 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDEEKFFPQSGVLIFGKEDSGGNNIEIERVMITDEEEIRTTNPVATEQYGSVSTNLQAGNAQAATADVN

SEQ ID NO: 906 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGNHTISQLGFSQAGASDIRDQSRNWLPGPCYRQQRVSKTHGDNNNSNFSWTGATTYHLNGRDSLVNPGPAMASHKDDDDRFFPQSGVLIFGKEGTGANNAEIGEVMITDEEEIRTTNPVATEQYGSVSTNLQAGNAQAATADVN

SEQ ID NO: 907 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRNNKAADSGVQ

SEQ ID NO: 908 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQAAHNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 909 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGHMTLSGLRFSQAGASDIRDQSRNWLPGPCYRQQRVSKTSADNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 910 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSAGTATISRLRFSQAGASDIRDQSRNWLPGPCYRQQRVSKTSADNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 911 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHRTQAAVRNVD

SEQ ID NO: 912 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGQNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 913 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGTNTLSRLLFSQAGASDIRDQSRNWLPGPCYRQQRVSKQPNDNNNSEFSWTGATTYHLNGRDSLVNPGPAMASHKDDNEKFFPQSGVLIFGKEGANGTNVEIGKVMITDEEEIRTTNPVATEQYGSVSTNLQAGNAQAATADVN

SEQ ID NO: 914 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEGKFFPQSGVLIFGKQGSEKTNVDIEKVMITDEEEIRTTNPVATEQYGSVSTNLQRGNRQAATADVN

SEQ ID NO: 915 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDAGKTNIDIGQVMITDEEEIRTTNPVATEQYGSVSTNLQAGNAQAATADVN

SEQ ID NO: 916 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPKSRAAFGDVT

SEQ ID NO: 917 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 918 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRGEAATRSVA

SEQ ID NO: 919 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 920 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGRFFPQSGVLIFGKQDAGKSNADIDRVMITDEEEIRTTNPVATEQYGSVSTNLQAGNAQAATADVN

SEQ ID NO: 921 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSKQDADNNNSDFSWPGATKYHLNGRDSLVNPGPAMASHGDDKEKFFPQSGVLIFGKQGSEKTNVDIEKVMITDEEEIRTTNPVATEQYGSVSTNLQAGNAQAATADVN

SEQ ID NO: 922 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 923 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGASKTDVAVGHVMITDEEEIRTTNPVATEQYGSVSTNLQAGNAQAATADVN

SEQ ID NO: 924 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSAHNNNSNFSWTGATKYHLNGRDSLVNPGPAMASHKDDEEKFFPQSGVLIFGKEGANGTNVEIGKVMITDEEEIRTTNPVATEQYGSVSTNLQAGNAQAATADVN

SEQ ID NO: 925 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 926 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEDTTGGNVDIEGVMITDEEEIRTTNPVATEQYGSVSTNLQAGNAQAATADVN

SEQ ID NO: 927 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 928 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDTDNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 929 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 930 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTSADNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 931 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHNNRAAFTDVE

SEQ ID NO: 932 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQYDRNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 933 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGRMTMSKLQFSQAGASDIRDQSRNWLPGPCYRQQRVSKTDGENNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 934 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDDDRFFPQSGVLIFGKEGTSKDNVAFDQVMITDEEEIRTTNPVATEQYGSVSTNLQAGNAQAATADVN

SEQ ID NO: 935 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQSGKKSDIDVDDVMITDEEEIRTTNPVATEQYGSVSTNLQAGNAQAATADVN

SEQ ID NO: 936 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGEGGLTTTSKLGFSQAGASDIRDQSRNWLPGPCYRQQRVSKTPNGNNNSDFSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 937 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRSNTAADAAVN

SEQ ID NO: 938 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKEDGAAANVDIGQVMITDEEEIRTTNPVATEQYGSVSTNLQAGNAQAATADVN

SEQ ID NO: 939 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGKFFPQSGVLIFGKQGSEKTNVDIEKVMITDEEEIRTTNPVATEQYGSVSTNLQAGNAQAATADVN

SEQ ID NO: 940 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQDTDNNNSDFSWTGATKYHLNGRDSLVNPGPAMASHGDDDGKFFPQSGVLIFGKQSATANNIDIDQVMITDEEEIRTTNPVATEQYGSVSTNLQAGNAQAATADVN

SEQ ID NO: 941 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 942 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 943 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQGGIATQSRLKFSQAGASDIRDQSRNWLPGPCYRQQRVSKQASDNNNSEFSWTGATKYHLNGRDSLVNPGPAMASHKDDEEKFFPQSGVLIFGKQGSTGTDVAYEGVMITDEEEIRTTNPVATEQYGSVSTNLQAGNAQAATADVN

SEQ ID NO: 944 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKEDAGKADVEIGKVMITDEEEIRTTNPVATEQYGSVSTNLQAGNAQAATADVN

SEQ ID NO: 945 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDTGKGDVAIEHVMITDEEEIRTTNPVATEQYGSVSTNLQAGNAQAATADVN

SEQ ID NO: 946 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDKFFPQSGVLIFGKQGAKGTDVAYDGVMITDEEEIRTTNPVATEQYGSVSTNLQAGNAQAATADVN

SEQ ID NO: 947 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDRFFPQSGVLIFGKEGAGESNADYEQVMITDEEEIRTTNPVATEQYGSVSTNLQAGNAQAATADVN

SEQ ID NO: 948 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSTTPADNNNSDFSWTGATKYHLNGRDSLVNPGPAMASHKDDDEKFFPQSGVLIFGKQSSKATNTEIDSVMITDEEEIRTTNPVATEQYGSVSTNLQAGNAQAATADVN

SEQ ID NO: 949 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDDDKFFPQSGVLIFGKENSEEGNVDIDSVMITDEEEIRTTNPVATEQYGSVSTNLQAGNAQAATADVN

SEQ ID NO: 950 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQNAGATDVAFDEVMITDEEEIRTTNPVATEQYGSVSTNLQAGNAQAATADVN

SEQ ID NO: 951 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKQSGDNNNSEFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 952 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDADKFFPQSGVLIFGKQNSETNNVDIEGVMITDEEEIRTTNPVATEQYGSVSTNLQAGNAQAATADVN

SEQ ID NO: 953 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSARADVAYEGVMITDEEEIRTTNPVATEQYGSVSTNLQAGNAQAATADVN

SEQ ID NO: 954 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKQDAENNNSEFSWPGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 955 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGSLTMSRLIFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 956 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 957 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQDTAKANAAIGEVMITDEEEIRTTNPVATEQYGSVSTNLQAGNAQAATADVN

SEQ ID NO: 958 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRSGIKTTSHLGFSQAGASDIRDQSRNWLPGPCYRQQRVSKQANHNNNSEFSWTGATTYHLNGRDSLVNPGPAMASHEDDTEKFFPQSGVLIFGKEGAGANDVAVEHVMITDEEEIRTTNPVATEQYGSVSTNLQAGNAQAATADVN

SEQ ID NO: 959 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRTRNEAAVHDVN

SEQ ID NO: 960 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEGKFFPQSGVLIFGKESAAKDNVEIGNVMITDEEEIRTTNPVATEQYGSVSTNLQAGNAQAATADVN

SEQ ID NO: 961 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAARSNVDYEHVMITDEEEIRTTNPVATEQYGSVSTNLQAGNAQAATADVN

SEQ ID NO: 962 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNRDGAAASEVQ

SEQ ID NO: 963 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHVTQSRLLFSQAGASDIRDQSRNWLPGPCYRQQRVSTQSTGNNNSDFSWTGATKYHLNGRDSLVNPGPAMASHKDDDDRFFPQSGVLIFGKQGTGRSNVEIGSVMITDEEEIRTTNPVATEQYGSVSTNLQAGNAQAATADVN

SEQ ID NO: 964 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDKDRFFPQSGVLIFGKQGSEKTNVDIEKVMITDEEEIRTTNPVATEQYGSVSTNLQAGNAQAATADVN

SEQ ID NO: 965 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPAGIATMSTLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 966 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDKFFPQSGVLIFGKQGAKGTNVAVEKVMITDEEEIRTTNPVATEQYGSVSTNLQAGNAQAATADVN

SEQ ID NO: 967 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAGGSTTPSRLRFSQAGASDIRDQSRNWLPGPCYRQQRVSTKDDRNNNSDFSWTGATKYHLNGRDSLVNPGPAMASHKDDDDRFFPQSGVLIFGKQSTAGTDVDFDQVMITDEEEIRTTNPVATEQYGSVSTNLQAGNAQAATADVN

SEQ ID NO: 968 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 969 - protein, 334 aa, Artificial Sequence; identical to SEQ ID NO: 353
  Synthetic

SEQ ID NO: 970 - protein, 334 aa, Artificial Sequence; identical to SEQ ID NO: 192
  Synthetic

SEQ ID NO: 971 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 972 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 973 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 974 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESADRSDVDYEHVMITDEEEIRTTNPVATEQYGSVSTNLQAGNAQAATADVN

SEQ ID NO: 975 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKEDGGGSNVEYGSVMITDEEEIRTTNPVATEQYGSVSTNLQRGNRQAATADVN

SEQ ID NO: 976 - protein, 334 aa, Artificial Sequence; identical to SEQ ID NO: 409
  Synthetic

SEQ ID NO: 977 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDTAKGNAAVDQVMITDEEEIRTTNPVATEQYGSVSTNLQAGNAQAATADVN

SEQ ID NO: 978 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGASTYHLNGRDSLVNPGPAMASHKDDEDKFFPQSGVLIFGKQGSEETNVDIGHVMITDEEEIRTTNPVATEQYGSVSTNLQAGNAQEATADVN

SEQ ID NO: 979 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAEANNVAVGDVMITDEEEIRTTNPVATEQYGSVSTNLQAGNAQAATADVN

SEQ ID NO: 980 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKESAAASDVDVGQVMITDEEEIRTTNPVATEQYGSVSTNLQAGNAQAATADVN

SEQ ID NO: 981 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKESSTGTDADIDQVMITDEEEIRTTNPVATEQYGSVSTNLQAGNAQAATADVN

SEQ ID NO: 982 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDDEKFFPQSGVLIFGKEGAGEGNIDIERVMITDEEEIRTTNPVATEQYGSVSTNLQAGNAQAATADVN

SEQ ID NO: 983 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKQGTEGGNIEVDDVMITDEEEIRTTNPVATEQYGSVSTNLQAGNAQAATADVN

SEQ ID NO: 984 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 985 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKKPDQNNNSEFSWTGATKYHLNGRDSLVNPGPAMASHKDDDDRFFPQSGVLIFGKENAGRSDIEIGQVMITDEEEIRTTNPVATEQYGSVSTNLQAGNAQAATADVN

SEQ ID NO: 986 - protein, 334 aa, Artificial Sequence; identical to SEQ ID NO: 163
  Synthetic

SEQ ID NO: 987 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKESGGTDNVDIDRVMITDEEEIRTTNPVATEQYGSVSTNLQAGNAQAATADVN

SEQ ID NO: 988 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQGSARDNIAIEGVMITDEEEIRTTNPVATEQYGSVSTNLQAGNAQAATADVN

SEQ ID NO: 989 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDSEKSNVAIGGVMITDEEEIRTTNPVATEQYGSVSTNLQAGNAQAATADVN

SEQ ID NO: 990 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSTNSAAAFGVVA

SEQ ID NO: 991 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTDNNNSNFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 992 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSGRNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 993 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTARGAAAASAVE

SEQ ID NO: 994 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQSGREGDAEIEDVMITDEEEIRTTNPVATEQYGSVSTNLQAGNAQAATADVN

SEQ ID NO: 995 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKVSADNNNSEFSWTGATKYHLNGRDSLVNPGPAMASHRDDAEKFFPQSGVLIFGKQGSEKTNVDIEKVMITDEEEIRTTNPVATEQYGSVSTNLQAGNAQAATADVN

SEQ ID NO: 996 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDDSGIHTKSKLKFSQAGASDIRDQSRNWLPGPCYRQQRVSKQSDRNNNSEFSWTGATKYHLNGRDSLVNPGPAMASHKDDEDKFFPQSGVLIFGKQGATKTDIAIDRVMITDEEEIRTTNPVATEQYGSVSTNLQAGNAQAATADVN

SEQ ID NO: 997 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQGSEKTNVDIEKVMITDEEEIRTTNPVATEQYGSVSTNLQRGNRQAATADVN

SEQ ID NO: 998 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDAENNNSEFSWPGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 999 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPSRNNNSEFSWTGATTYHLNGRDSLVNPGPAMASHKDDDEKFFPQSGVLIFGKEGATGTNVAIGKVMITDEEEIRTTNPVATEQYGSVSTNLQAGNAQAATADVN

SEQ ID NO: 1000 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 1001 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDAGTTNAAIEHVMITDEEEIRTTNPVATEQYGSVSTNLQAGNAQAATADVN

SEQ ID NO: 1002 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGTGTMTKSQLGFSQAGASDIRDQSRNWLPGPCYRQQRVSKQSGQNNNSDFSWTGATKYHLNGRDSLVNPGPAMASHRDDDGKFFPQSGVLIFGKQNAARTDVAIGEVMITDEEEIRTTNPVATEQYGSVSTNLQAGNAQAATADVN

SEQ ID NO: 1003 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNKTMSRLQFSQAGASDIRDQSRNWLPGPCYRQQRVSKKPSENNNSDFSWTGATTYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 1004 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDKGKFFPQSGVLIFGKQGSEKTNVDIEKVMITDEEEIRTTNPVATEQYGSVSTNLQAGNAQAATADVN

SEQ ID NO: 1005 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQRGNRQAATADVN

SEQ ID NO: 1006 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKEDTGKANVDIGNVMITDEEEIRTTNPVATEQYGSVSTNLQAGNAQAATADVN

SEQ ID NO: 1007 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAGGHVTISRLKFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1008 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDKGKFFPQSGVLIFGKQGSEKTNVDIEKVMITDEEEIRTTNPVATEQYGSVSTNLQAGNAQAATADVN

SEQ ID NO: 1009 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGTMTQSKLRFSQAGASDIRDQSRNWLPGPCYRQQRVSKVSADNNNSEFSWTGATKYHLNGRDSLVNPGPAMASHKDDEEKFFPQSGVLIFGKQGAATDNAAIDQVMITDEEEIRTTNPVATEQYGSVSTNLQAGNAQAATADVN

SEQ ID NO: 1010 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKESSDRNNVDIEQVMITDEEEIRTTNPVATEQYGSVSTNLQAGNAQAATADVN

SEQ ID NO: 1011 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1012 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKQGSAKSDVAYEGVMITDEEEIRTTNPVATEQYGSVSTNLQAGNAQAATADVN

SEQ ID NO: 1013 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHKDDADKFFPQSGVLIFGKQGNAASNAEIGEVMITDEEEIRTTNPVATEQYGSVSTNLQAGNAQAATADVN

SEQ ID NO: 1014 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 1015 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAPRAPAAIRDVA

SEQ ID NO: 1016 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNHRNTAADAEVA

SEQ ID NO: 1017 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQGGNVTHSKLRFSQAGASDIRDQSRNWLPGPCYRQQRVSKQYGQNNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 1018 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGLLTHSGLRFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 1019 - protein, 334 aa, Artificial Sequence; identical to SEQ ID NO: 425
  Synthetic

SEQ ID NO: 1020 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDASTNDAAYEQVMITDEEEIRTTNPVATEQYGSVSTNLQAGNAQAATADVN

SEQ ID NO: 1021 - protein, 334 aa, Artificial Sequence; identical to SEQ ID NO: 345
  Synthetic

SEQ ID NO: 1022 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQGTGTSNVDYGSVMITDEEEIRTTNPVATEQYGSVSTNLQAGNAQAATADVN

SEQ ID NO: 1023 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQAGNRQAATADVN

SEQ ID NO: 1024 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLKKSTLQFSQAGASDIRDQSRNWLPGPCYRQQRVSKQSADNNNSDFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 1025 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSSGNHTISPLRFSQAGASDIRDQSRNWLPGPCYRQQRVSKQSDHNNNSNFSWTGATKYHLNGRDSLVNPGPAMASHKDDDDKFFPQSGVLIFGKQGAAETDVDIENVMITDEEEIRTTNPVATEQYGSVSTNLQAGNAQAATADVN

SEQ ID NO: 1026 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHEDDNEKFFPQSGVLIFGKESSGANNVEVDGVMITDEEEIRTTNPVATEQYGSVSTNLQAGNAQAATADVN

SEQ ID NO: 1027 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGRNTTSTLLFSQAGASDIRDQSRNWLPGPCYRQQRVSKTSADNNNSNFSWTGATKYHLNGRDSLVNPGPAMASHRDDEDKFFPQSGVLIFGKQGSAASNADVGQVMITDEEEIRTTNPVATEQYGSVSTNLQAGNAQAATADVN

SEQ ID NO: 1028 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHEDDADKFFPQSGVLIFGKQSAKGGNVEYGDVMITDEEEIRTTNPVATEQYGSVSTNLQAGNAQAATADVN

SEQ ID NO: 1029 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRSSGAADTNVD

SEQ ID NO: 1030 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 1031 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEVKFFPQSGVLIFGKQGSEKTNVDIEKVMITDEEEIRTTNPVATEQYGSVSTNLQRGNRQAATADVN

SEQ ID NO: 1032 - protein, 334 aa, Artificial Sequence
  Synthetic
PAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 1033 - protein, 334 aa, Artificial Sequence; identical to SEQ ID NO: 516
  Synthetic

SEQ ID NO: 1034 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPRASAASSAVN

SEQ ID NO: 1035 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEGTNESDTDIDKVMITDEEEIRTTNPVATEQYGSVSTNLQAGNAQAATADVN

SEQ ID NO: 1036 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGPATKSALGFSQAGASDIRDQSRNWLPGPCYRQQRVSKTAADNNNSDFSWTGATKYHLNGRDSLVNPGPAMASHKDDDGKFFPQSGVLIFGKQNSGRSNVEIGKVMITDEEEIRTTNPVATEQYGSVSTNLQAGNAQAATADVN

SEQ ID NO: 1037 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDEKFFPQSGVLIFGKQSGSKNDIAIEDVMITDEEEIRTTNPVATEQYGSVSTNLQAGNAQAATADVN

SEQ ID NO: 1038 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTRATAADKIVD

SEQ ID NO: 1039 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGPQTTSTLRFSQAGASDIRDQSRNWLPGPCYRQQRVSKTDGENNNSDFSWTGATKYHLNGRDSLVNPGPAMASHRDDEEKFFPQSGVLIFGKQNSGATDVAIGGVMITDEEEIRTTNPVATEQYGSVSTNLQAGNAQAATADVN

SEQ ID NO: 1040 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDTRGRAADRIVH

SEQ ID NO: 1041 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSTDNNNSNFSWTGATKYHLNGRDSLVNPGPAMASHKDDEEKFFPQSGVLIFGKQSASKNNIAIEEVMITDEEEIRTTNPVATEQYGSVSTNLQAGNAQAATADVN

SEQ ID NO: 1042 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPQDGAAADEVH

SEQ ID NO: 1043 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPARNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1044 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 1045 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGTAGNNIEIDGVMITDEEEIRTTNPVATEQYGSVSTNLQAGNAQAATADVN

SEQ ID NO: 1046 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGHMTPSRLQFSQAGASDIRDQSRNWLPGPCYRQQRVSKTSNGNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1047 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTAGTDTKSRLKFSQAGASDIRDQSRNWLPGPCYRQQRVSKKYTDNNNSNFSWTGATTYHLNGRDSLVNPGPAMASHRDDTDRFFPQSGVLIFGKQGSEKTNVDIEKVMITDEEEIRTTNPVATEQYGSVSTNLQAGNAQAATADVN

SEQ ID NO: 1048 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRATAAIHDVD

SEQ ID NO: 1049 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPRAPAAVRGVE

SEQ ID NO: 1050 - protein, 334 aa, Artificial Sequence; identical to SEQ ID NO: 422
  Synthetic

SEQ ID NO: 1051 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTADHNNNSDFSWTGATKYHLNGRDSLVNPGPAMASHGDDAERFFPQSGVLIFGKQGSEKTNVDIEKVMITDEEEIRTTNPVATEQYGSVSTNLQAGNAQAATADVN

SEQ ID NO: 1052 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGRVTTSALGFSQAGASDIRDQSRNWLPGPCYRQQRVSKQDAENNNSEFSWPGATKYHLNGRDSLVNPGPAMASHKDDEGKFFPQSGVLIFGKEGTGRNDVAIEEVMITDEEEIRTTNPVATEQYGSVSTNLQAGNAQAATADVN

SEQ ID NO: 1053 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 1054 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKESAGKTNTEYDKVMITDEEEIRTTNPVATEQYGSVSTNLQAGNAQAATADVN

SEQ ID NO: 1055 - protein, 334 aa, Artificial Sequence
  Synthetic
ETGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1056 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGRNTTSTLLFSQAGASDIRDQSRNWLPGPCYRQQRVSKQSGQNNNSDFSWTGATKYHLNGRDSLVNPGPAMASHEDDAGKFFPQSGVLIFGKQGSEKTNVDIEKVMITDEEEIRTTNPVATEQYGSVSTNLQAGNAQAATADVN

SEQ ID NO: 1057 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTGKFFPQSGVLIFGKESSDRNNVDIEQVMITDEEEIRTTNPVATEQYGSVSTNLQAGNAQAATADVN

SEQ ID NO: 1058 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSDFSWTGATTYHLNGRDSLVNPGPAMASHRDDDGKFFPQSGVLIFGKQNSAEANVAYDDVMITDEEEIRTTNPVATEQYGSVSTNLQAGNAQAATADVN

SEQ ID NO: 1059 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1060 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKESAARTNIEIDEVMITDEEEIRTTNPVATEQYGSVSTNLQAGNAQAATADVN

SEQ ID NO: 1061 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGPTTLSRLGFSQAGASDIRDQSRNWLPGPCYRQQRVSKVSADNNNSEFSWTGATKYHLNGRDSLVNPGPAMASHKDDEEKFFPQSGVLIFGKENSGETNIAIDRVMITDEEEIRTTNPVATEQYGSVSTNLQRGNRQAATADVN

SEQ ID NO: 1062 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLHFSQAGASDIRDQSRNWLPGPCYRQQRVSKQPNDNNNSEFSWTGATTYHLNGRDSLVNPGPAMASHKDDDEKFFPQSGVLIFGKEDAAGNDIEIGKVMITDEEEIRTTNPVATEQYGSVSTNLQAGNAQAATADVN

SEQ ID NO: 1063 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGPNTPSRLQFSQAGASDIRDQSRNWLPGPCYRQQRVSKQDTDNNNSDFSWTGATKYHLNGRDSLVNPGPAMASHRDDEDKFFPQSGVLIFGKEDAGKADVEIGKVMITDEEEIRTTNPVATEQYGSVSTNLQAGNAQAATADVN

SEQ ID NO: 1064 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRGHAATTNVD

SEQ ID NO: 1065 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTHGGLVTLSKLRFSQAGASDIRDQSRNWLPGPCYRQQRVSKQASDNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1066 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKQSDDNNNSDFSWPGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1067 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPDHNNNSDFSWTGATKYHLNGRDSLVNPGPAMASHKDDDDRFFPQSGVLIFGKENSTTGNIEVDRVMITDEEEIRTTNPVATEQYGSVSTNLQAGNAQAATADVN

SEQ ID NO: 1068 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDAAANNIEIDRVMITDEEEIRTTNPVATEQYGSVSTNLQAGNAQAATADVN

SEQ ID NO: 1069 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGNHTISQLGFSQAGASDIRDQSRNWLPGPCYRQQRVSKTSADNNNSNFSWTGATKYHLNGRDSLVNPGPAMASHRDDEDKFFPQSGVLIFGKQGAGANNVDFGEVMITDEEEIRTTNPVATEQYGSVSTNLQAGNAQAATADVN

SEQ ID NO: 1070 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQSTSRGDVDIGGVMITDEEEIRTTNPVATEQYGSVSTNLQAGNAQAATADVN

SEQ ID NO: 1071 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARTHAAYTEVA

SEQ ID NO: 1072 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGKFFPQSGVLIFGKQGSEKTNVDIEKVMITDEEEIRTTNPVATEQYGSVSTNLQRGNRQAATADVN

SEQ ID NO: 1073 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQETHGPAADHIVN

SEQ ID NO: 1074 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQNGSTTNVDIGGVMITDEEEIRTTNPVATEQYGSVSTNLQAGNAQAATADVN

SEQ ID NO: 1075 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSKTSTENNNSEFSWTGATTYHLNGRDSLVNPGPAMASHKDDNGRFFPQSGVLIFGKQGATESDVDFDQVMITDEEEIRTTNPVATEQYGSVSTNLQAGNAQAATADVN

SEQ ID NO: 1076 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDAGRFFPQSGVLIFGKQGAEKADVAYGQVMITDEEEIRTTNPVATEQYGSVSTNLQAGNAQAATADVN

SEQ ID NO: 1077 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDKFFPQSGVLIFGKQGSEKTNVDIEKVMITDEEEIRTTNPVATEQYGSVSTNLQRGNRQAATADVN

SEQ ID NO: 1078 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDDDRFFPQSGVLIFGKEDSGAGNVAVEGVMITDEEEIRTTNPVATEQYGSVSTNLQAGNAQAATADVN

SEQ ID NO: 1079 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATAGNKTTSALRFSQAGASDIRDQSRNWLPGPCYRQQRVSKTSADNNNSNFSWTGATKYHLNGRDSLVNPGPAMASHRDDEDKFFPQSGVLIFGKEGANGGNADIEDVMITDEEEIRTTNPVATEQYGSVSTNLQAGNAQAATADVN

SEQ ID NO: 1080 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKPTQNNNSNFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1081 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGNVTNSSLRFSQAGASDIRDQSRNWLPGPCYRQQRVSKQASDNNNSNFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 1082 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESATGGNTDIGGVMITDEEEIRTTNPVATEQYGSVSTNLQAGNAQAATADVN

SEQ ID NO: 1083 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGRVTLSNLGFSQAGASDIRDQSRNWLPGPCYRQQRVSKVSADNNNSEFSWTGATKYHLNGRDSLVNPGPAMASHKDDEEKFFPQSGVLIFGKENSGKANVDIEQVMITDEEEIRTTNPVATEQYGSVSTNLQAGNAQAATADVN

SEQ ID NO: 1084 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSTTKSNVAIGGVMITDEEEIRTTNPVATEQYGSVSTNLQAGNAQAATADVN

SEQ ID NO: 1085 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQDADGDNVDVDQVMITDEEEIRTTNPVATEQYGSVSTNLQAGNAQAATADVN

SEQ ID NO: 1086 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGGGLATKSRLRFSQAGASDIRDQSRNWLPGPCYRQQRVSKTAGRNNNSEFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1087 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSDGSDTDIGGVMITDEEEIRTTNPVATEQYGSVSTNLQAGNAQAATADVN

SEQ ID NO: 1088 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHGDDKGRFFPQSGVLIFGKQGSEKTNVDIEKVMITDEEEIRTTNPVATEQYGSVSTNLQAGNAQAATADVN

SEQ ID NO: 1089 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAKSGQAADARVD

SEQ ID NO: 1090 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSKTYGGNNNSEFSWTGATKYHLNGRDSLVNPGPAMASHEDDKDKFFPQSGVLIFGKQDAGGNNIAVEEVMITDEEEIRTTNPVATEQYGSVSTNLQAGNAQAATADVN

SEQ ID NO: 1091 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEEKFFPQSGVLIFGKQSAEKTNAAIGHVMITDEEEIRTTNPVATEQYGSVSTNLQAGNAQAATADVN

SEQ ID NO: 1092 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKQDAENNNSEFSWPGATKYHLNGRDSLVNPGPAMASHKDDEEKFFPQSGVLIFGKQGSEKTNVDIEKVMITDEEEIRTTNPVATEQYGSVSTNLQTGRASAASKEVQ

SEQ ID NO: 1093 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHGDDTDRFFPQSGVLIFGKQGSEKTNVDIEKVMITDEEEIRTTNPVATEQYGSVSTNLQRGNRQAATADVN

SEQ ID NO: 1094 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKKASDNNNSNFSWTGATTYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 1095 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSRGNNVDYGGVMITDEEEIRTTNPVATEQYGSVSTNLQAGNAQAATADVN

SEQ ID NO: 1096 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGRMTPSGLQFSQAGASDIRDQSRNWLPGPCYRQQRVSKTSADNNNSNFSWTGATKYHLNGRDSLVNPGPAMASHRDDEDKFFPQSGVLIFGKQGSAASNADVGQVMITDEEEIRTTNPVATEQYGSVSTNLQAGNAQAATADVN

SEQ ID NO: 1097 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTDKFFPQSGVLIFGKQGSEKTNVDIEKVMITDEEEIRTTNPVATEQYGSVSTNLQRGNRQAATADVN

SEQ ID NO: 1098 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDGSGGNTEIDGVMITDEEEIRTTNPVATEQYGSVSTNLQAGNAQAATADVN

SEQ ID NO: 1099 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSKQPSENNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 1100 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHAGNTTPSQLKFSQAGASDIRDQSRNWLPGPCYRQQRVSTQPTHNNNSNFSWTGATKYHLNGRDSLVNPGPAMASHRDDDDKFFPQSGVLIFGKQSATGSNVDIDQVMITDEEEIRTTNPVATEQYGSVSTNLQAGNAQAATADVN

SEQ ID NO: 1101 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDGKFFPQSGVLIFGKQDGEGTDIDIDRVMITDEEEIRTTNPVATEQYGSVSTNLQAGNAQAATADVN

SEQ ID NO: 1102 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDKDKFFPQSGVLIFGKQGSEKTNVDIEKVMITDEEEIRTTNPVATEQYGSVSTNLQRGNRQAATADVN

SEQ ID NO: 1103 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDRFFPQSGVLIFGKQGSDGSDTDIGGVMITDEEEIRTTNPVATEQYGSVSTNLQAGNAQAATADVN

SEQ ID NO: 1104 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKEGSSRNDVDIDRVMITDEEEIRTTNPVATEQYGSVSTNLQAGNAQAATADVN

SEQ ID NO: 1105 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNKGGNLTNSTLEFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1106 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSSAGLDTTSALQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1107 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNGHSAAATGEVK

SEQ ID NO: 1108 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 1109 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDGGGSNVDIEGVMITDEEEIRTTNPVATEQYGSVSTNLQAGNAQAATADVN

SEQ ID NO: 1110 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARHDRAASETVE

SEQ ID NO: 1111 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1112 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKTAADNNNSDFSWTGATKYHLNGRDSLVNPGPAMASHKDDDGKFFPQSGVLIFGKQDAGKANIDIDGVMITDEEEIRTTNPVATEQYGSVSTNLQAGNAQAATADVN

SEQ ID NO: 1113 - protein, 334 aa, Artificial Sequence; identical to SEQ ID NO: 340
  Synthetic

SEQ ID NO: 1114 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNRDPAAAAEVE

SEQ ID NO: 1115 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQGAGANNVDFGQVMITDEEEIRTTNPVATEQYGSVSTNLQAGNAQAATADVN

SEQ ID NO: 1116 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGNGGAATADVP

SEQ ID NO: 1117 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1118 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGRVTISGLRFSQAGASDIRDQSRNWLPGPCYRQQRVSKQANHNNNSDFSWTGATKYHLNGRDSLVNPGPAMASHRDDEDKFFPQSGVLIFGKEGAATSDIEIDRVMITDEEEIRTTNPVATEQYGSVSTNLQAGNAQAATADVN

SEQ ID NO: 1119 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKGGNVTLSGLGFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1120 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTATGITTNSKLGFSQAGASDIRDQSRNWLPGPCYRQQRVSKTPNGNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 1121 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHRDDAGRFFPQSGVLIFGKEDSKASNIDIEGVMITDEEEIRTTNPVATEQYGSVSTNLQAGNAQAATADVN

SEQ ID NO: 1122 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNKTQSALGFSQAGASDIRDQSRNWLPGPCYRQQRVSKVSADNNNSEFSWTGATKYHLNGRDSLVNPGPAMASHKDDNDKFFPQSGVLIFGKQGAAETDVDIENVMITDEEEIRTTNPVATEQYGSVSTNLQAGNAQAATADVN

SEQ ID NO: 1123 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSVDNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1124 - protein, 334 aa, Artificial Sequence
  Synthetic
HTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGIATKSELRFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 1125 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGSGGNDVDIGGVMITDEEEIRTTNPVATEQYGSVSTNLQAGNAQAATADVN

SEQ ID NO: 1126 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGTAKNNVAIGGVMITDEEEIRTTNPVATEQYGSVSTNLQAGNAQAATADVN

SEQ ID NO: 1127 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGHKTTSNLGFSQAGASDIRDQSRNWLPGPCYRQQRVSKQSDHNNNSNFSWTGATKYHLNGRDSLVNPGPAMASHKDDDDKFFPQSGVLIFGKEGAGANDVAYENVMITDEEEIRTTNPVATEQYGSVSTNLQAGNAQAATADVN

SEQ ID NO: 1128 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDAAKTNAAVDQVMITDEEEIRTTNPVATEQYGSVSTNLQAGNAQAATADVN

SEQ ID NO: 1129 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGHRTGAADATVH

SEQ ID NO: 1130 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANSGTNTLSHLRFSQAGASDIRDQSRNWLPGPCYRQQRVSKTSADNNNSEFSWTGATKYHLNGRDSLVNPGPAMASHKDDEEKFFPQSGVLIFGKQSASRNDVAVGEVMITDEEEIRTTNPVATEQYGSVSTNLQAGNAQAATADVN

SEQ ID NO: 1131 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGILTQSTLRFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1132 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHEDDTGRFFPQSGVLIFGKQDTGRNNVEIDSVMITDEEEIRTTNPVATEQYGSVSTNLQAGNAQAATADVN

SEQ ID NO: 1133 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKENSGGSDVEIDEVMITDEEEIRTTNPVATEQYGSVSTNLQAGNAQAATADVN

SEQ ID NO: 1134 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQSSAGNDVDVDNVMITDEEEIRTTNPVATEQYGSVSTNLQAGNAQAATADVN

SEQ ID NO: 1135 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQNTGGGNVDIDGVMITDEEEIRTTNPVATEQYGSVSTNLQAGNAQAATADVN

SEQ ID NO: 1136 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDERFFPQSGVLIFGKEGGGKNNIDFEEVMITDEEEIRTTNPVATEQYGSVSTNLQAGNAQAATADVN

SEQ ID NO: 1137 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1138 - protein, 334 aa, Artificial Sequence
  Synthetic
ETGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSVTHSTLGFSQAGASDIRDQSRNWLPGPCYRQQRVSKTDGENNNSDFSWTGATKYHLNGRDSLVNPGPAMASHKDDEEKFFPQSGVLIFGKQSAAGADVAIDSVMITDEEEIRTTNPVATEQYGSVSTNLQAGNAQAATADVN

SEQ ID NO: 1139 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1140 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDAAKTNAAVDQVMITDEEEIRTTNPVATEQYGSVSTNLQAGNAQAATADVN

SEQ ID NO: 1141 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGGGKTNIDIGHVMITDEEEIRTTNPVATEQYGSVSTNLQAGNAQAATADVN

SEQ ID NO: 1142 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSNFSWTGATTYHLNGRDSLVNPGPAMASHGDDNEKFFPQSGVLIFGKQGTKKGDVDFGQVMITDEEEIRTTNPVATEQYGSVSTNLQAGNAQAATADVN

SEQ ID NO: 1143 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGINTHSRLQFSQAGASDIRDQSRNWLPGPCYRQQRVSKTSADNNNSNFSWTGATKYHLNGRDSLVNPGPAMASHRDDEDKFFPQSGVLIFGKEDAGTTNVAFDKVMITDEEEIRTTNPVATEQYGSVSTNLQAGNAQAATADVN

SEQ ID NO: 1144 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGLNTISGLRFSQAGASDIRDQSRNWLPGPCYRQQRVSKKYTDNNNSNFSWTGATTYHLNGRDSLVNPGPAMASHGDDDDKFFPQSGVLIFGKEDAARTDVAIDKVMITDEEEIRTTNPVATEQYGSVSTNLQAGNAQAATADVN

SEQ ID NO: 1145 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLKFSQAGASDIRDQSRNWLPGPCYRQQRVSKTDGENNNSDFSWTGATKYHLNGRDSLVNPGPAMASHKDDDGRFFPQSGVLIFGKQSGTGDDTDVDGVMITDEEEIRTTNPVATEQYGSVSTNLQAGNAQAATADVN

SEQ ID NO: 1146 - protein, 334 aa, Artificial Sequence; identical to SEQ ID NO: 158
  Synthetic

SEQ ID NO: 1147 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKEDAGTTNVAFDKVMITDEEEIRTTNPVATEQYGSVSTNLQAGNAQAATADVN

SEQ ID NO: 1148 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRDRDEAAVGGVN

SEQ ID NO: 1149 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSTAADVDVEEVMITDEEEIRTTNPVATEQYGSVSTNLQAGNAQAATADVN

SEQ ID NO: 1150 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKRHSGAAFSVVD

SEQ ID NO: 1151 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKRPTDNNNSDFSWTGATKYHLNGRDSLVNPGPAMASHEDDNEKFFPQSGVLIFGKQSSSGNNIDIGHVMITDEEEIRTTNPVATEQYGSVSTNLQAGNAQAATADVN

SEQ ID NO: 1152 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNSSGSATHSQLGFSQAGASDIRDQSRNWLPGPCYRQQRVSKTHGDNNNSNFSWTGATTYHLNGRDSLVNPGPAMASHKDDAEKFFPQSGVLIFGKQGAGKSDVDIGRVMITDEEEIRTTNPVATEQYGSVSTNLQAGNAQAATADVN

SEQ ID NO: 1153 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPRAAAAAGVVT

SEQ ID NO: 1154 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSRKNDVAIGGVMITDEEEIRTTNPVATEQYGSVSTNLQAGNAQAATADVN

SEQ ID NO: 1155 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQSSRTTNVAIDDVMITDEEEIRTTNPVATEQYGSVSTNLQAGNAQAATADVN

SEQ ID NO: 1156 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEGTGANNAEIGEVMITDEEEIRTTNPVATEQYGSVSTNLQAGNAQAATADVN

SEQ ID NO: 1157 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 1158 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPAGHATQSGLRFSQAGASDIRDQSRNWLPGPCYRQQRVSKTPAGNNNSKFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 1159 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGSTTMSKLMFSQAGASDIRDQSRNWLPGPCYRQQRVSKTSADNNNSNFSWTGATKYHLNGRDSLVNPGPAMASHRDDEDKFFPQSGVLIFGKEDAGKADVEIGKVMITDEEEIRTTNPVATEQYGSVSTNLQAGNAQAATADVN

SEQ ID NO: 1160 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHNTKSGLEFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1161 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 1162 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQATRNTAAVDVVH

SEQ ID NO: 1163 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKQGAGKDDVDIGGVMITDEEEIRTTNPVATEQYGSVSTNLQAGNAQAATADVN

SEQ ID NO: 1164 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTDNNNSEFSWTGATKYHLNGRDSLVNPGPAMASHRDDEDKFFPQSGVLIFGKENGKTANVAIDRVMITDEEEIRTTNPVATEQYGSVSTNLQAGNAQAATADVN

SEQ ID NO: 1165 - protein, 334 aa, Artificial Sequence; identical to SEQ ID NO: 496
  Synthetic

SEQ ID NO: 1166 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGSEKTNVDIEKVMITDEEEIRTTNPVATEQYGSVSTNLQRGNRQAATADVN

SEQ ID NO: 1167 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPAGNNNSKFSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1168 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGRGPAAARTVD

SEQ ID NO: 1169 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDDRNNNSEFSWTGATKYHLNGRDSLVNPGPAMASHKDDEEKFFPQSGVLIFGKQSTAEGNVDFEKVMITDEEEIRTTNPVATEQYGSVSTNLQAGNAQAATADVN

SEQ ID NO: 1170 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQDSGGSDVAYDRVMITDEEEIRTTNPVATEQYGSVSTNLQAGNAQAATADVN

SEQ ID NO: 1171 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEDASGTNVDFDRVMITDEEEIRTTNPVATEQYGSVSTNLQAGNAQAATADVN

SEQ ID NO: 1172 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNAGHKTTSDLRFSQAGASDIRDQSRNWLPGPCYRQQRVSKTSADNNNSEFSWTGATKYHLNGRDSLVNPGPAMASHKDDEDKFFPQSGVLIFGKQGSDTNNVEIDRVMITDEEEIRTTNPVATEQYGSVSTNLQAGNAQAATADVN

SEQ ID NO: 1173 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1174 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDSGRANVDFEKVMITDEEEIRTTNPVATEQYGSVSTNLQAGNAQAATADVN

SEQ ID NO: 1175 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNLTTSELRFSQAGASDIRDQSRNWLPGPCYRQQRVSKTSADNNNSNFSWTGATKYHLNGRDSLVNPGPAMASHRDDEDKFFPQSGVLIFGKEGAKAADAAYDEVMITDEEEIRTTNPVATEQYGSVSTNLQAGNAQAATADVN

SEQ ID NO: 1176 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1177 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1178 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAESGTATTSRLRFSQAGASDIRDQSRNWLPGPCYRQQRVSKQPNDNNNSEFSWTGATKYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 1179 - protein, 334 aa, Artificial Sequence; identical to SEQ ID NO: 482
  Synthetic

SEQ ID NO: 1180 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKQHGGNNNSEFSWTGATKYHLNGRDSLVNPGPAMASHKDDEEKFFPQSGVLIFGKQGAGADDVDIDQVMITDEEEIRTTNPVATEQYGSVSTNLQAGNAQAATADVN

SEQ ID NO: 1181 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1182 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSTTPADNNNSDFSWTGATKYHLNGRDSLVNPGPAMASHKDDDEKFFPQSGVLIFGKQDANTNNADVDSVMITDEEEIRTTNPVATEQYGSVSTNLQAGNAQAATADVN

SEQ ID NO: 1183 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEDTAGANVDIDRVMITDEEEIRTTNPVATEQYGSVSTNLQAGNAQAATADVN

SEQ ID NO: 1184 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGTGKNNIAFEDVMITDEEEIRTTNPVATEQYGSVSTNLQAGNAQAATADVN

SEQ ID NO: 1185 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1186 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1187 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1188 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1189 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQDTAKANAAIGEVMITDEEEIRTTNPVATEQYGSVSTNLQAGNAQAATADVN

SEQ ID NO: 1190 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGAKANDVDIGSVMITDEEEIRTTNPVATEQYGSVSTNLQAGNAQAATADVN

SEQ ID NO: 1191 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSGLRFSQAGASDIRDQSRNWLPGPCYRQQRVSKQPTRNNNSDFSWTGATKYHLNGRDSLVNPGPAMASHEDDNGKFFPQSGVLIFGKENATASDVDIGSVMITDEEEIRTTNPVATEQYGSVSTNLQAGNAQAATADVN

SEQ ID NO: 1192 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQSGLNTLSDLRFSQAGASDIRDQSRNWLPGPCYRQQRVSKTAADNNNSDFSWTGATKYHLNGRDSLVNPGPAMASHRDDEGKFFPQSGVLIFGKQGARRSNADFDDVMITDEEEIRTTNPVATEQYGSVSTNLQAGNAQAATADVN

SEQ ID NO: 1193 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQAGNAQAATADVN

SEQ ID NO: 1194 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKESARGSDVAIDEVMITDEEEIRTTNPVATEQYGSVSTNLQAGNAQAATADVN

SEQ ID NO: 1195 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDEKFFPQSGVLIFGKQDASGSNVDIGGVMITDEEEIRTTNPVATEQYGSVSTNLQAGNAQAATADVN

SEQ ID NO: 1196 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 1197 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGHATMSSLVFSQAGASDIRDQSRNWLPGPCYRQQRVSKTDGENNNSDFSWTGATKYHLNGRDSLVNPGPAMASHKDDEEKFFPQSGVLIFGKQSAKAANAAIDEVMITDEEEIRTTNPVATEQYGSVSTNLQAGNAQAATADVN

SEQ ID NO: 1198 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGPITPSPLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1199 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGLDTTSRLRFSQAGASDIRDQSRNWLPGPCYRQQRVSTTPADNNNSDFSWTGATKYHLNGRDSLVNPGPAMASHKDDDEKFFPQSGVLIFGKESGGKGNVEIEQVMITDEEEIRTTNPVATEQYGSVSTNLQAGNAQAATADVN

SEQ ID NO: 1200 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNTGSKTLSRLKFSQAGASDIRDQSRNWLPGPCYRQQRVSKTDGENNNSDFSWTGATKYHLNGRDSLVNPGPAMASHKDDEEKFFPQSGVLIFGKEGAAGDNIDVERVMITDEEEIRTTNPVATEQYGSVSTNLQAGNAQAATADVN

SEQ ID NO: 1201 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKHGGNNNSNFSWTGATKYHLNGRDSLVNPGPAMASHKDDDEKFFPQSGVLIFGKEGGDGSNVDFERVMITDEEEIRTTNPVATEQYGSVSTNLQAGNAQAATADVN

SEQ ID NO: 1202 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSAKAANAAIDEVMITDEEEIRTTNPVATEQYGSVSTNLQAGNAQAATADVN

SEQ ID NO: 1203 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDERFFPQSGVLIFGKESTKRTNVDVGEVMITDEEEIRTTNPVATEQYGSVSTNLQAGNAQAATADVN

SEQ ID NO: 1204 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSEKTNVDIEKVMITDEEEIRTTNPVATEQYGSVSTNLQRGNRQAATADVN

SEQ ID NO: 1205 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTDRFFPQSGVLIFGKEGSKKNDAEVGQVMITDEEEIRTTNPVATEQYGSVSTNLQAGNAQAATADVN

SEQ ID NO: 1206 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 1207 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNATHSQLRFSQAGASDIRDQSRNWLPGPCYRQQRVSKVSADNNNSEFSWTGATKYHLNGRDSLVNPGPAMASHKDDEEKFFPQSGVLIFGKQGAAATNVDIGRVMITDEEEIRTTNPVATEQYGSVSTNLQAGNAQAATADVN

SEQ ID NO: 1208 - protein, 334 aa, Artificial Sequence; identical to SEQ ID NO: 103
  Synthetic

SEQ ID NO: 1209 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTATRNNNSDFSWTGATKYHLNGRDSLVNPGPAMASHEDDNEKFFPQSGVLIFGKEGSRRANVDIEYVMITDEEEIRTTNPVATEQYGSVSTNLQAGNAQAATADVN

SEQ ID NO: 1210 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQSTAAGNVDVDGVMITDEEEIRTTNPVATEQYGSVSTNLQAGNAQAATADVN

SEQ ID NO: 1211 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPAGNTTLSRLLFSQAGASDIRDQSRNWLPGPCYRQQRVSKVSADNNNSEFSWTGATKYHLNGRDSLVNPGPAMASHRDDEDKFFPQSGVLIFGKEGAAGSDVDIEKVMITDEEEIRTTNPVATEQYGSVSTNLQAGNAQAATADVN

SEQ ID NO: 1212 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRATAADDAVN

SEQ ID NO: 1213 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDGKFFPQSGVLIFGKQNGGGDNVDIGRVMITDEEEIRTTNPVATEQYGSVSTNLQAGNAQAATADVN

SEQ ID NO: 1214 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTQSRAADRGVN

SEQ ID NO: 1215 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKQSSKATNTEIDSVMITDEEEIRTTNPVATEQYGSVSTNLQAGNAQAATADVN

SEQ ID NO: 1216 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKESSTGSDVDVDRVMITDEEEIRTTNPVATEQYGSVSTNLQAGNAQAATADVN

SEQ ID NO: 1217 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGILTQSTLRFSQAGASDIRDQSRNWLPGPCYRQQRVSKQASDNNNSNFSWTGATTYHLNGRDSLVNPGPAMASHKDDEGRFFPQSGVLIFGKQDAGATDVEVDEVMITDEEEIRTTNPVATEQYGSVSTNLQRGNRQAATADVN

SEQ ID NO: 1218 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSKTDGENNNSDFSWTGATKYHLNGRDSLVNPGPAMASHKDDNDKFFPQSGVLIFGKENAAGGDTDIGRVMITDEEEIRTTNPVATEQYGSVSTNLQAGNAQAATADVN

SEQ ID NO: 1219 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSTTPADNNNSDFSWTGATKYHLNGRDSLVNPGPAMASHKDDDDRFFPQSGVLIFGKENTKGDNVDIDKVMITDEEEIRTTNPVATEQYGSVSTNLQAGNAQAATADVN

SEQ ID NO: 1220 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARAGLTTLSQLGFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1221 - protein, 334 aa, Artificial Sequence; identical to SEQ ID NO: 378
  Synthetic

SEQ ID NO: 1222 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 1223 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKENAGRTDIDIGSVMITDEEEIRTTNPVATEQYGSVSTNLQAGNAQAATADVN

SEQ ID NO: 1224 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKQDAENNNSEFSWPGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1225 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGKFFPQSGVLIFGKQGTGASNADIDHVMITDEEEIRTTNPVATEQYGSVSTNLQAGNAQAATADVN

SEQ ID NO: 1226 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 1227 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGLNTISGLRFSQAGASDIRDQSRNWLPGPCYRQQRVSTQPTDNNNSDFSWTGATKYHLNGRDSLVNPGPAMASHKDDEEKFFPQSGVLIFGKQNAAANNVEFEHVMITDEEEIRTTNPVATEQYGSVSTNLQAGNAQAATADVN

SEQ ID NO: 1228 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATKYHLNGRDSLVNPGPAMASHKDDNDRFFPQSGVLIFGKEDSRKSNADIEGVMITDEEEIRTTNPVATEQYGSVSTNLQAGNAQAATADVN

SEQ ID NO: 1229 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGHMTPSRLQFSQAGASDIRDQSRNWLPGPCYRQQRVSKTSADNNNSDFSWTGATKYHLNGRDSLVNPGPAMASHKDDEGRFFPQSGVLIFGKQNAGASDADFDQVMITDEEEIRTTNPVATEQYGSVSTNLQAGNAQAATADVN

SEQ ID NO: 1230 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 1231 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGHATTSRLGFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 1232 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKEDGDGANVAIDRVMITDEEEIRTTNPVATEQYGSVSTNLQAGNAQAATADVN

SEQ ID NO: 1233 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 1234 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQNSAGANAEYDDVMITDEEEIRTTNPVATEQYGSVSTNLQAGNAQAATADVN

SEQ ID NO: 1235 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRHRGGAATDDVT

SEQ ID NO: 1236 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGRGGSPTKSMLGFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1237 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKQGAGKNNAAIGQVMITDEEEIRTTNPVATEQYGSVSTNLQAGNAQAATADVN

SEQ ID NO: 1238 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAPRDPAATASVN

SEQ ID NO: 1239 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGTGKDNVAIGGVMITDEEEIRTTNPVATEQYGSVSTNLQAGNAQAATADVN

SEQ ID NO: 1240 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSATGSMTKSRLRFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1241 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDDGNNNSNFSWTGATKYHLNGRDSLVNPGPAMASHKDDEEKFFPQSGVLIFGKEGSRRANVDIEYVMITDEEEIRTTNPVATEQYGSVSTNLQAGNAQAATADVN

SEQ ID NO: 1242 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTGKFFPQSGVLIFGKQGSEKTNVDIEKVMITDEEEIRTTNPVATEQYGSVSTNLQAGNAQAATADVN

SEQ ID NO: 1243 - protein, 334 aa, Artificial Sequence
  Synthetic
QTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 1244 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGASTANVAIGQVMITDEEEIRTTNPVATEQYGSVSTNLQAGNAQAATADVN

SEQ ID NO: 1245 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSATGPVTTSQLGFSQAGASDIRDQSRNWLPGPCYRQQRVSTQDGENNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 1246 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAGKTDVAIGRVMITDEEEIRTTNPVATEQYGSVSTNLQAGNAQAATADVN

SEQ ID NO: 1247 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 1248 - protein, 334 aa, Artificial Sequence; identical to SEQ ID NO: 132
  Synthetic

SEQ ID NO: 1249 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSARAPAAVHNVA

SEQ ID NO: 1250 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKKDAENNNSEFSWTGATKYHLNGRDSLVNPGPAMASHKDDDEKFFPQSGVLIFGKEGSRGTDVDFDGVMITDEEEIRTTNPVATEQYGSVSTNLQAGNAQAATADVN

SEQ ID NO: 1251 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPGDNNNSNFSWTGATKYHLNGRDSLVNPGPAMASHKDDDEKFFPQSGVLIFGKENSTTGNIEIDRVMITDEEEIRTTNPVATEQYGSVSTNLQAGNAQAATADVN

SEQ ID NO: 1252 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDEGRFFPQSGVLIFGKEGTSGDDVEYDNVMITDEEEIRTTNPVATEQYGSVSTNLQAGNAQAATADVN

SEQ ID NO: 1253 - protein, 334 aa, Artificial Sequence
  Synthetic
HTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 1254 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAGGTLTPSPLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1255 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSTAAGNVDVDGVMITDEEEIRTTNPVATEQYGSVSTNLQAGNAQAATADVN

SEQ ID NO: 1256 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDGRFFPQSGVLIFGKQGSEKTNVDIEKVMITDEEEIRTTNPVATEQYGSVSTNLQRGNRQAATADVN

SEQ ID NO: 1257 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARGNAAAGRVD

SEQ ID NO: 1258 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSKQYGQNNNSDFSWTGATTYHLNGRDSLVNPGPAMASHEDDNGRFFPQSGVLIFGKQGSEKTNVDIEKVMITDEEEIRTTNPVATEQYGSVSTNLQAGNAQAATADVN

SEQ ID NO: 1259 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGTLTPSGLGFSQAGASDIRDQSRNWLPGPCYRQQRVSKTHGDNNNSNFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 1260 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQDAGRNNIAIDGVMITDEEEIRTTNPVATEQYGSVSTNLQAGNAQAATADVN

SEQ ID NO: 1261 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKPDQNNNSEFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 1262 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDAGESNVAIGDVMITDEEEIRTTNPVATEQYGSVSTNLQAGNAQAATADVN

SEQ ID NO: 1263 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHVTHSGLRFSQAGASDIRDQSRNWLPGPCYRQQRVSKTSADNNNSNFSWTGATKYHLNGRDSLVNPGPAMASHRDDEDKFFPQSGVLIFGKQSAKAANAAIDEVMITDEEEIRTTNPVATEQYGSVSTNLQAGNAQAATADVN

SEQ ID NO: 1264 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPTGHPTMSRLRFSQAGASDIRDQSRNWLPGPCYRQQRVSKTAADNNNSDFSWTGATKYHLNGRDSLVNPGPAMASHKDDDGKFFPQSGVLIFGKQSTSRGDVDIGGVMITDEEEIRTTNPVATEQYGSVSTNLQAGNAQAATADVN

SEQ ID NO: 1265 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDRFFPQSGVLIFGKQGSEKTNVDIEKVMITDEEEIRTTNPVATEQYGSVSTNLQRGNRQAATADVN

SEQ ID NO: 1266 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPHGPAADEMVP

SEQ ID NO: 1267 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTSGNLTKSDLRFSQAGASDIRDQSRNWLPGPCYRQQRVSKQSSDNNNSEFSWTGATKYHLNGRDSLVNPGPAMASHRDDADKFFPQSGVLIFGKQGAAKDNIAIEKVMITDEEEIRTTNPVATEQYGSVSTNLQAGNAQAATADVN

SEQ ID NO: 1268 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 1269 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSLTMSRLGFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1270 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHVTQSRLLFSQAGASDIRDQSRNWLPGPCYRQQRVSKKDDGNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1271 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKDNGRAAFGVVN

SEQ ID NO: 1272 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPTGNNTTSSLHFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1273 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDNDKFFPQSGVLIFGKENSGKANVDIEQVMITDEEEIRTTNPVATEQYGSVSTNLQAGNAQAATADVN

SEQ ID NO: 1274 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRAGNTTPSRLLFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 1275 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 1276 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSITNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPNGTAAFNVVD

SEQ ID NO: 1277 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKESSDRNNVDIEQVMITDEEEIRTTNPVATEQYGSVSTNLQAGNAQAATADVN

SEQ ID NO: 1278 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKESSNRDNVAIEGVMITDEEEIRTTNPVATEQYGSVSTNLQAGNAQAATADVN

SEQ ID NO: 1279 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAARGTKTTSELLFSQAGASDIRDQSRNWLPGPCYRQQRVSKTDGENNNSDFSWTGATKYHLNGRDSLVNPGPAMASHKDDEEKFFPQSGVLIFGKEDGGKGDIAIDRVMITDEEEIRTTNPVATEQYGSVSTNLQAGNAQAATADVN

SEQ ID NO: 1280 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTTSTLQFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 1281 - protein, 334 aa, Artificial Sequence; identical to SEQ ID NO: 471
  Synthetic

SEQ ID NO: 1282 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRQTKAASDDVN

SEQ ID NO: 1283 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPDQNNNSEFSWTGATKYHLNGRDSLVNPGPAMASHKDDEGKFFPQSGVLIFGKQGSREGDVDIGQVMITDEEEIRTTNPVATEQYGSVSTNLQAGNAQAATAGVN

SEQ ID NO: 1284 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKQGSEKTNVDIEKVMITDEEEIRTTNPVATEQYGSVSTNLQRGNRQAATADVN

SEQ ID NO: 1285 - protein, 334 aa, Artificial Sequence
  Synthetic
KAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGSETTSRLRFSQAGASDIRDQSRNWLPGPCYRQQRVSKTPNGNNNSDFSWTGATKYHLNGRDSLVNPGPAMASHGDDNDRFFPQSGVLIFGKQDGGGNNVDIERVMITDEEEIRTTNPVATEQYGSVSTNLQAGNAQAATADVN

SEQ ID NO: 1286 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTATGNNNSNFSWPGATTYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 1287 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGARTADTEIDSVMITDEEEIRTTNPVATEQYGSVSTNLQAGNAQAATADVN

SEQ ID NO: 1288 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1289 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQGAAKSDIDIEKVMITDEEEIRTTNPVATEQYGSVSTNLQAGNAQAATADVN

SEQ ID NO: 1290 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQGSAGSNIAFDGVMITDEEEIRTTNPVATEQYGSVSTNLQAGNAQAATADVN

SEQ ID NO: 1291 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARAGLTTLSQLGFSQAGASDIRDQSRNWLPGPCYRQQRVSKTDGENNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1292 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSTTGANVDVEQVMITDEEEIRTTNPVATEQYGSVSTNLQAGNAQAATADVN

SEQ ID NO: 1293 - protein, 334 aa, Artificial Sequence; identical to SEQ ID NO: 394
  Synthetic

SEQ ID NO: 1294 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNGRAPAAATVVD

SEQ ID NO: 1295 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQATRSTAATDEVA

SEQ ID NO: 1296 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1297 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNQTNSDLKFSQAGASDIRDQSRNWLPGPCYRQQRVSKTSTENNNSEFSWTGATTYHLNGRDSLVNPGPAMASHEDDKDKFFPQSGVLIFGKQGTGKANVDIGNVMITDEEEIRTTNPVATEQYGSVSTNLQAGNAQAATADVN

SEQ ID NO: 1298 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAAGHPTPSQLKFSQAGASDIRDQSRNWLPGPCYRQQRVSKQPNDNNNSEFSWTGATTYHLNGRDSLVNPGPAMASHKDDNEKFFPQSGVLIFGKEGTSKDNVAFDQVMITDEEEIRTTNPVATEQYGSVSTNLQAGNAQAATADVN

SEQ ID NO: 1299 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDAENNNSDFSWTGATKYHLNGRDSLVNPGPAMASHRDDAEKFFPQSGVLIFGKQGSEKTNVDIEKVMITDEEEIRTTNPVATEQYGSVSTNLQAGNAQAATADVN

SEQ ID NO: 1300 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGTVTTSHLRFSQAGASDIRDQSRNWLPGPCYRQQRVSKKDDGNNNSNFSWTGATTYHLNGRDSLVNPGPAMASHKDDEEKFFPQSGVLIFGKENGDKTNVEIDRVMITDEEEIRTTNPVATEQYGSVSTNLQAGNAQAATADVN

SEQ ID NO: 1301 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSKQSSDNNNSEFSWTGATKYHLNGRDSLVNPGPAMASHRDDEDKFFPQSGVLIFGKQSANESDVDIDQVMITDEEEIRTTNPVATEQYGSVSTNLQAGNAQAATADVN

SEQ ID NO: 1302 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKEGASTNDVDIEKVMITDEEEIRTTNPVATEQYGSVSTNLQAGNAQAATADVN

SEQ ID NO: 1303 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKESGSKSNIAIDQVMITDEEEIRTTNPVATEQYGSVSTNLQAGNAQAATADVN

SEQ ID NO: 1304 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRSGAANQAVH

SEQ ID NO: 1305 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGTVTTSHLRFSQAGASDIRDQSRNWLPGPCYRQQRVSKQPSRNNNSEFSWTGATKYHLNGRDSLVNPGPAMASHEDDNGKFFPQSGVLIFGKQGAGTSDIAIDRVMITDEEEIRTTNPVATEQYGSVSTNLQAGNAQAATADVN

SEQ ID NO: 1306 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQSSSTTNVEIGHVMITDEEEIRTTNPVATEQYGSVSTNLQAGNAQAATADVN

SEQ ID NO: 1307 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSKLSFSQAGASDIRDQSRNWLPGPCYRQQRVSKTSADNNNSEYSWTGATKYHLNGRDSLVNPGPAMASHKDDEEKFFPQSGVLIFGKEGAAGNDVEFDQVMITDEEEIRTTNPVATEQYGSVSTNLQRGNRQAATADVN

SEQ ID NO: 1308 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKENGEAGNVDVEHVMITDEEEIRTTNPVATEQYGSVSTNLQAGNAQAATADVN

SEQ ID NO: 1309 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKASDNNNSNFSWTGATTYHLNGRDSLVNPGPAMASHRDDADKFFPQSGVLIFGKQGAAANNVEIDGVMITDEEEIRTTNPVATEQYGSVSTNLQAGNAQAATADVN

SEQ ID NO: 1310 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTKTNSSLSFSQAGASDIRDQSRNWLPGPCYRQQRVSKTAADNNNSDFSWTGATKYHLNGRDSLVNPGPAMASHKDDDGKFFPQSGVLIFGKEGSEKTNVDIEKVMITDEEEIRTTNPVATEQYGSVSTNLQAGNAQAATADVN

SEQ ID NO: 1311 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSERTPAAFATVQ

SEQ ID NO: 1312 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDGENNNSDFSWTGATKYHLNGRDSLVNPGPAMASHKDDDGKFFPQSGVLIFGKENTATDDVDIGHVMITDEEEIRTTNPVATEQYGSVSTNLQAGNAQAATADVN

SEQ ID NO: 1313 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGRVTISNLRFSQAGASDIRDQSRNWLPGPCYRQQRVSKTSADNNNSNFSWTGATKYHLNGRDSLVNPGPAMASHRDDEDKFFPQSGVLIFGKQDASGDDVEVDKVMITDEEEIRTTNPVATEQYGSVSTNLQAGNAQAATADVN

SEQ ID NO: 1314 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPANGNNNSEFSWTGATTYHLNGRDSLVNPGPAMASHKDDEGRFFPQSGVLIFGKQDASKNNVDVDGVMITDEEEIRTTNPVATEQYGSVSTNLQAGNAQAATADVN

SEQ ID NO: 1315 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGPTTLSRLGFSQAGASDIRDQSRNWLPGPCYRQQRVSKTAADNNNSDFSWTGATKYHLNGRDSLVNPGPAMASHKDDNDKFFPQSGVLIFGKQGGAANDVDIEHVMITDEEEIRTTNPVATEQYGSVSTNLQAGNAQAATADVN

SEQ ID NO: 1316 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAGRNNTDIDDVMITDEEEIRTTNPVATEQYGSVSTNLQAGNAQAATADVN

SEQ ID NO: 1317 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDDGNNNSNFSWTGATTYHLNGRDSLVNPGPAMASHRDDADKFFPQSGVLIFGKEGAGGSNVAVDGVMITDEEEIRTTNPVATEQYGSVSTNLQAGNAQAATADVN

SEQ ID NO: 1318 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTKTGNKTQSALGFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQASSNHAAAKGVD

SEQ ID NO: 1319 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSSLQFSQAGASDIRDQSRNWLPGPCYRQQRVSKQPGDNNNSNFSWTGATKYHLNGRDSLVNPGPAMASHKDDDDRFFPQSGVLIFGKEDSGKGDVAYDRVMITDEEEIRTTNPVATEQYGSVSTNLQAGNAQAATADVN

SEQ ID NO: 1320 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAGRFFPQSGVLIFGKQDAGKANIDIDGVMITDEEEIRTTNPVATEQYGSVSTNLQAGNAQAATADVN

SEQ ID NO: 1321 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPSSAAAIQKVH

SEQ ID NO: 1322 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGTGPKTLSDLSFSQAGASDIRDQSRNWLPGPCYRQQRVSKKYTDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1323 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQATKTPAASDAVE

SEQ ID NO: 1324 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNTGSKTLSRLKFSQAGASDIRDQSRNWLPGPCYRQQRVSTKAGENNNSNFSWTGATTYHLNGRDSLVNPGPAMASHRDDEGKFFPQSGVLIFGKQSGEKNDVDIDGVMITDEEEIRTTNPVATEQYGSVSTNLQAGNAQAATADVN

SEQ ID NO: 1325 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRSPAASANVD

SEQ ID NO: 1326 - protein, 334 aa, Artificial Sequence
  Synthetic
NSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSRTGTATQSTLNFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1327 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHSGRTTPSGLSFSQAGASDIRDQSRNWLPGPCYRQQRVSKVSADNNNSEFSWTGATKYHLNGRDSLVNPGPAMASHKDDEEKFFPQSGVLIFGKENSGKANVDIGQVMITDEEEIRTTNPVATEQYGSVSTNLQAGNAQAATADVN

SEQ ID NO: 1328 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGGGESDVEIDKVMITDEEEIRTTNPVATEQYGSVSTNLQAGNAQAATADVN

SEQ ID NO: 1329 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTSADNNNSEYSWTGATKYHLNGRDSLVNPGPAMASHEDDTDKFFPQSGVLIFGKQGSEKTNVDIEKVMITDEEEIRTTNPVATEQYGSVSTNLQRGNRQAATADVN

SEQ ID NO: 1330 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRRTEAASRVVA

SEQ ID NO: 1331 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSGTNDVAYDEVMITDEEEIRTTNPVATEQYGSVSTNLQAGNAQAATADVN

SEQ ID NO: 1332 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAAHDGAATREVN

SEQ ID NO: 1333 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGTEKSNVAIERVMITDEEEIRTTNPVATEQYGSVSTNLQAGNAQAATADVN

SEQ ID NO: 1334 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQGSEKTNVDIEKVMITDEEEIRTTNPVATEQYGSVSTNLQRGNRQAATADVN

SEQ ID NO: 1335 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSAHNNNSNFSWTGATKYHLNGRDSLVNPGPAMASHKDDEEKFFPQSGVLIFGKQGAGKDDIAIDNVMITDEEEIRTTNPVATEQYGSVSTNLQAGNAQAATADVN

SEQ ID NO: 1336 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDDGNNNSNFSWTGATTYHLNGRDSLVNPGPAMASHGDDDDKFFPQSGVLIFGKQGSNGTNVDVDGVMITDEEEIRTTNPVATEQYGSVSTNLQAGNAQAATADVN

SEQ ID NO: 1337 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGPETTSGLRFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 1338 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1339 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGTGKNNIAFEDVMITDEEEIRTTNPVATEQYGSVSTNLQAGNAQAATADVN

SEQ ID NO: 1340 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSGKGDVAIDRVMITDEEEIRTTNPVATEQYGSVSTNLQAGNAQAATADVN

SEQ ID NO: 1341 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSTKSNENNNSDFSWTGATKYHLNGRDSLVNPGPAMASHKDDEEKFFPQSGVLIFGKQNSAETNVEIDGVMITDEEEIRTTNPVATEQYGSVSTNLQAGNAQAATADVN

SEQ ID NO: 1342 - protein, 334 aa, Artificial Sequence
  Synthetic
HTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKKYTDNNNSNFSWTGATTYHLNGRDSLVNPGPAMASHRDDEDKFFPQSGVLIFGKEGGAGSDVEIDKVMITDEEEIRTTNPVATEQYGSVSTNLQAGNAQAATADVN

SEQ ID NO: 1343 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1344 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSMTKSGLMFSQAGASDIRDQSRNWLPGPCYRQQRVSKQSSDNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1345 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQDAGRNNIAIDKVMITDEEEIRTTNPVATEQYGSVSTNLQAGNAQAATADVN

SEQ ID NO: 1346 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENASKGNADVDSVMITDEEEIRTTNPVATEQYGSVSTNLQAGNAQAATADVN

SEQ ID NO: 1347 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKPPNGNNNSEFSWTGATTYHLNGRDSLVNPGPAMASHKDDDDRFFPQSGVLIFGKQDSGGTNVDIGHVMITDEEEIRTTNPVATEQYGSVSTNLQAGNAQAATADVN

SEQ ID NO: 1348 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKENTSEGNVDIGHVMITDEEEIRTTNPVATEQYGSVSTNLQAGNAQAATADVN

SEQ ID NO: 1349 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 1350 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNKTLSRLKFSQAGASDIRDQSRNWLPGPCYRQQRVSKVSADNNNSEFSWTGATKYHLNGRDSLVNPGPAMASHKDDEEKFFPQSGVLIFGKENARASDADIGSVMITDEEEIRTTNPVATEQYGSVSTNLQAGNAQAATADVN

SEQ ID NO: 1351 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1352 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRHSQAATKDVE

SEQ ID NO: 1353 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPAGIATMSTLRFSQAGASDIRDQSRNWLPGPCYRQQRVSTQSTGNNNSDFSWTGATKYHLNGRDSLVNPGPAMASHKDDDDRFFPQSGVLIFGKQGTRKNDVAIDEVMITDEEEIRTTNPVATEQYGSVSTNLQAGNAQAATADVN

SEQ ID NO: 1354 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGRATNSELRFSQAGASDIRDQSRNWLPGPCYRQQRVSKKYTDNNNSNFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 1355 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQADRNNNSNFSWTGATTYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 1356 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKHGGNNNSDFSWTGATKYHLNGRDSLVNPGPAMASHKDDDDKFFPQSGVLIFGKQDSRKTNVAFDDVMITDEEEIRTTNPVATEQYGSVSTNLQAGNAQAATADVN

SEQ ID NO: 1357 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGILTQSTLRFSQAGASDIRDQSRNWLPGPCYRQQRVSKQASDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 1358 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKQGTEEGNIEIEHVMITDEEEIRTTNPVATEQYGSVSTNLQAGNAQAATADVN

SEQ ID NO: 1359 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEERFFPQSGVLIFGKQGGSATNIDIGGVMITDEEEIRTTNPVATEQYGSVSTNLQAGNAQAATADVN

SEQ ID NO: 1360 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1361 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGTVTNDADIESVMITDEEEIRTTNPVATEQYGSVSTNLQAGNAQAATADVN

SEQ ID NO: 1362 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKEGAGRTNADFDRVMITDEEEIRTTNPVATEQYGSVSTNLQAGNAQAATADVN

SEQ ID NO: 1363 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPRGGAATTMVH

SEQ ID NO: 1364 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKTSADNNNSEYSWTGATKYHLNGRDSLVNPGPAMASHKDDEEKFFPQSGVLIFGKEGASKANTAVEHVMITDEEEIRTTNPVATEQYGSVSTNLQAGNAQAATADVN

SEQ ID NO: 1365 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGSTRSDVAFDDVMITDEEEIRTTNPVATEQYGSVSTNLQAGNAQAATADVN

SEQ ID NO: 1366 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTASHNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 1367 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKEGSAGADIEIEHVMITDEEEIRTTNPVATEQYGSVSTNLQAGNAQAATADVN

SEQ ID NO: 1368 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSNFSWTGATTYHLNGRDSLVNPGPAMASHEDDAGRFFPQSGVLIFGKQGSEKTNVDIEKVMITDEEEIRTTNPVATEQYGSVSTNLQAGNAQAATADVN

SEQ ID NO: 1369 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKDRTPAAFQAVD

SEQ ID NO: 1370 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKDHTQAASAAVA

SEQ ID NO: 1371 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 1372 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGAAGLTTLSNLSFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1373 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNVTNSSLRFSQAGASDIRDQSRNWLPGPCYRQQRVSKTYNDNNNSEFSWTGATTYHLNGRDSLVNPGPAMASHRDDEGKFFPQSGVLIFGKQGSEKTNVDIEKVMITDEEEIRTTNPVATEQYGSVSTNLQAGNAQAATADVN

SEQ ID NO: 1374 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEGSGKSNTDFDSVMITDEEEIRTTNPVATEQYGSVSTNLQAGNAQAATADVN

SEQ ID NO: 1375 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKEGTATDDVDIDGVMITDEEEIRTTNPVATEQYGSVSTNLQAGNAQAATADVN

SEQ ID NO: 1376 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKEGAKENNADIDEVMITDEEEIRTTNPVATEQYGSVSTNLQAGNAQAATADVN

SEQ ID NO: 1377 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGHDTTSELRFSQAGASDIRDQSRNWLPGPCYRQQRVSKPPNGNNNSEFSWTGATTYHLNGRDSLVNPGPAMASHKDDDDRFFPQSGVLIFGKQGTGKNNIAFEDVMITDEEEIRTTNPVATEQYGSVSTNLQAGNAQAATADVN

SEQ ID NO: 1378 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTRKNNVDIEQVMITDEEEIRTTNPVATEQYGSVSTNLQAGNAQAATVDVN

SEQ ID NO: 1379 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKTAADNNNSDFSWTGATKYHLNGRDSLVNPGPAMASHKDDDGKFFPQSGVLIFGKEGAGKGDVEYEKVMITDEEEIRTTNPVATEQYGSVSTNLQAGNAQAATADVN

SEQ ID NO: 1380 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 1381 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPAENNNSNFSWTGATKYHLNGRDSLVNPGPAMASHRDDEDKFFPQSGVLIFGKESATKANADIDRVMITDEEEIRTTNPVATEQYGSVSTNLQAGNAQAATADVN

SEQ ID NO: 1382 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGSATNSRLRFSQAGASDIRDQSRNWLPGPCYRQQRVSKTDGENNNSDFSWTGATKYHLNGRDSLVNPGPAMASHKDDDDRFFPQSGVLIFGKQDAGKANIDIDGVMITDEEEIRTTNPVATEQYGSVSTNLQAGNAQAATADVN

SEQ ID NO: 1383 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGPETTSGLRFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 1384 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDGSRTDVAVEEVMITDEEEIRTTNPVATEQYGSVSTNLQAGNAQAATADVN

SEQ ID NO: 1385 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDATGTLTISNLRFSQAGASDIRDQSRNWLPGPCYRQQRVSKKDSRNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1386 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKQASDNNNSEFSWTGATKYHLNGRDSLVNPGPAMASHKDDEEKFFPQSGVLIFGKESAAASDVDVGQVMITDEEEIRTTNPVATEQYGSVSTNLQAGNAQAATADVN

SEQ ID NO: 1387 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKQGSGADNIAIEGVMITDEEEIRTTNPVATEQYGSVSTNLQAGNAQAATADVN

SEQ ID NO: 1388 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDAGRFFPQSGVLIFGKESATKANADIDRVMITDEEEIRTTNPVATEQYGSVSTNLQAGNAQAATADVN

SEQ ID NO: 1389 - protein, 334 aa, Artificial Sequence; identical to SEQ ID NO: 370
  Synthetic

SEQ ID NO: 1390 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTATRNNNSDFSWTGATKYHLNGRDSLVNPGPAMASHKDDEEKFFPQSGVLIFGKEDADGTDTDIEHVMITDEEEIRTTNPVATEQYGSVSTNLQAGNAQAATADVN

SEQ ID NO: 1391 - protein, 334 aa, Artificial Sequence; identical to SEQ ID NO: 382
  Synthetic

SEQ ID NO: 1392 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGSMTNSGLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1393 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1394 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQGGIATQSRLKFSQAGASDIRDQSRNWLPGPCYRQQRVSKQSADNNNSDFSWTGATKYHLNGRDSLVNPGPAMASHGDDDGKFFPQSGVLIFGKQGSEKTNVDIEKVMITDEEEIRTTNPVATEQYGSVSTNLQAGNAQAATADVN

SEQ ID NO: 1395 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTASHNNNSDFSWTGATKYHLNGRDSLVNPGPAMASHKDDDDRFFPQSGVLIFGKQGAGKANVEFGGVMITDEEEIRTTNPVATEQYGSVSTNLQAGNAQAATADVN

SEQ ID NO: 1396 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDATGTLTISNLRFSQAGASDIRDQSRNWLPGPCYRQQRVSTTPADNNNSDFSWTGATKYHLNGRDSLVNPGPAMASHKDDDEKFFPQSGVLIFGKQGSTTSDVDFEHVMITDEEEIRTTNPVATEQYGSVSTNLQAGNAQAATADVN

SEQ ID NO: 1397 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTAQSGAAFNDVD

SEQ ID NO: 1398 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGSNGAATGGVT

SEQ ID NO: 1399 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEGRFFPQSGVLIFGKENTSRNDVEVESVMITDEEEIRTTNPVATEQYGSVSTNLQRGNRQAATADVN

SEQ ID NO: 1400 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKSGSITNSKLRFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1401 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 1402 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDAGKFFPQSGVLIFGKQGSEKTNVDIEKVMITDEEEIRTTNPVATEQYGSVSTNLQAGNAQAATADVN

SEQ ID NO: 1403 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGITTKSRLQFSQAGASDIRDQSRNWLPGPCYRQQRVSKQSDRNNNSEFSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 1404 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQDTGGNDAEIDQVMITDEEEIRTTNPVATEQYGSVSTNLQAGNAQAATADVN

SEQ ID NO: 1405 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGRFFPQSGVLIFGKQNGDTSDVAIEQVMITDEEEIRTTNPVATEQYGSVSTNLQAGNAQAATADVN

SEQ ID NO: 1406 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKENSGKGNVEFEQVMITDEEEIRTTNPVATEQYGSVSTNLQAGNAQAATADVN

SEQ ID NO: 1407 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKEGATRGDTEIDRVMITDEEEIRTTNPVATEQYGSVSTNLQAGNAQAATADVN

SEQ ID NO: 1408 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDDKFFPQSGVLIFGKESSDRNNVAIDNVMITDEEEIRTTNPVATEQYGSVSTNLQAGNAQAATADVN

SEQ ID NO: 1409 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAGANDVAVEHVMITDEEEIRTTNPVATEQYGSVSTNLQAGNAQAATADVN

SEQ ID NO: 1410 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGATADDADIGSVMITDEEEIRTTNPVATEQYGSVSTNLQAGNAQAATADVN

SEQ ID NO: 1411 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNDGGPATKSTLRFSQAGASDIRDQSRNWLPGPCYRQQRVSKQHNQNNNSEFSWTGATTYHLNGRDSLVNPGPAMASHKDDNEKFFPQSGVLIFGKEGTGANNAEIGEVMITDEEEIRTTNPVATEQYGSVSTNLQAGNAQAATADVN

SEQ ID NO: 1412 - protein, 334 aa, Artificial Sequence; identical to SEQ ID NO: 512
  Synthetic

SEQ ID NO: 1413 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1414 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQDTGKGDVAIEHVMITDEEEIRTTNPVATEQYGSVSTNLQAGNAQAATADVN

SEQ ID NO: 1415 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTSAQAAVRVVD

SEQ ID NO: 1416 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQDAGESNVAFEQVMITDEEEIRTTNPVATEQYGSVSTNLQAGNAQAATADVN

SEQ ID NO: 1417 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHRDDEDKFFPQSGVLIFGKENGRENDVAIDDVMITDEEEIRTTNPVATEQYGSVSTNLQAGNAQAATADVN

SEQ ID NO: 1418 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNNQGRAAYTGVE

SEQ ID NO: 1419 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKQGSEKTNVDIEKVMITDEEEIRTTNPVATEQYGSVSTNLQAGNAQAATADVN

SEQ ID NO: 1420 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDAGKFFPQSGVLIFGKQGASETNVEIDNVMITDEEEIRTTNPVATEQYGSVSTNLQAGNAQAATADVN

SEQ ID NO: 1421 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKESAKTADAAVDDVMITDEEEIRTTNPVATEQYGSVSTNLQAGNAQAATADVN

SEQ ID NO: 1422 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTSADNNNSEYSWTGATKYHLNGRDSLVNPGPAMASHGDDAERFFPQSGVLIFGKEGAGKTDVAIGRVMITDEEEIRTTNPVATEQYGSVSTNLQAGNAQAATADVN

SEQ ID NO: 1423 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRSGIITQSALRFSQAGASDIRDQSRNWLPGPCYRQQRVSKTSADNNNSEYSWTGATKYHLNGRDSLVNPGPAMASHKDDAGKFFPQSGVLIFGKEGAGGDNAAIDDVMITDEEEIRTTNPVATEQYGSVSTNLQAGNAQAATADVN

SEQ ID NO: 1424 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGRTTMSGLRFSQAGASDIRDQSRNWLPGPCYRQQRVSKQSTDNNNSNFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 1425 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTNTQSGLRFSQAGASDIRDQSRNWLPGPCYRQQRVSKQSDHNNNSNFSWTGATKYHLNGRDSLVNPGPAMASHKDDDDKFFPQSGVLIFGKQNAAKANVDIGDVMITDEEEIRTTNPVATEQYGSVSTNLQAGNAQAATADVN

SEQ ID NO: 1426 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGNVTLSDLQFSQAGASDIRDQSRNWLPGPCYRQQRVSKQSDRNNNSEFSWTGATKYHLNGRDSLVNPGPAMASHKDDDGRFFPQSGVLIFGKEGATGTNVAIGKVMITDEEEIRTTNPVATEQYGSVSTNLQAGNAQAATADVN

SEQ ID NO: 1427 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTQNNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1428 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGTRKNDVAIDKVMITDEEEIRTTNPVATEQYGSVSTNLQAGNAQAATADVN

SEQ ID NO: 1429 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHRDDDEKFFPQSGVLIFGKESSTTGNVAIEGVMITDEEEIRTTNPVATEQYGSVSTNLQAGNAQAATADVN

SEQ ID NO: 1430 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDATGTQTLSGLQFSQAGASDIRDQSRNWLPGPCYRQQRVSKKDTDNNNSEFSWTGATTYHLNGRDSLVNPGPAMASHKDDDERFFPQSGVLIFGKQGSEKTNVDIEKVMITDEEEIRTTNPVATEQYGSVSTNLQRGNRQAATADVN

SEQ ID NO: 1431 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAHNNNSEYSWTGATKYHLNGRDSLVNPGPAMASHRDDDDKFFPQSGVLIFGKEDGAAANVDIGQVMITDEEEIRTTNPVATEQYGSVSTNLQAGNAQAATADVN

SEQ ID NO: 1432 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGNDTLSQLRFSQAGASDIRDQSRNWLPGPCYRQQRVSKTSADNNNSNFSWTGATKYHLNGRDSLVNPGPAMASHRDDEDKFFPQSGVLIFGKEGTRKNNVDIEQVMITDEEEIRTTNPVATEQYGSVSTNLQAGNAQAATADVN

SEQ ID NO: 1433 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEDKFFPQSGVLIFGKESANKTNIDIEHVMITDEEEIRTTNPVATEQYGSVSTNLQAGNAQAATADVN

SEQ ID NO: 1434 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAESGTATTSRLRFSQAGASDIRDQSRNWLPGPCYRQQRVSKTPNDNNNSNFSWTGATKYHLNGRDSLVNPGPAMASHKDDEEKFFPQSGVLIFGKESSTRSDIDFDHVMITDEEEIRTTNPVATEQYGSVSTNLQAGNAQAATADVN

SEQ ID NO: 1435 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQGGNVTHSKLRFSQAGASDIRDQSRNWLPGPCYRQQRVSKTSADNNNSEYSWTGATKYHLNGRDSLVNPGPAMASHKDDEEKFFPQSGVLIFGKQNGSANNVEIDQVMITDEEEIRTTNPVATEQYGSVSTNLQAGNAQAATADVN

SEQ ID NO: 1436 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKDSRNNNSDFSWTGATTYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 1437 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSHRGEAAFDVVT

SEQ ID NO: 1438 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGNVTNSSLRFSQAGASDIRDQSRNWLPGPCYRQQRVSTTPADNNNSDFSWTGATKYHLNGRDSLVNPGPAMASHKDDDGKFFPQSGVLIFGKEGTDGNDADIGQVMITDEEEIRTTNPVATEQYGSVSTNLQAGNAQAATADVN

SEQ ID NO: 1439 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSGSGIKTKSDLRFSQAGASDIRDQSRNWLPGPCYRQQRVSKKPDQNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 1440 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGSGITTKSKLGFSQAGASDIRDQSRNWLPGPCYRQQRVSKQASDNNNSEFSWTGATKYHLNGRDSLVNPGPAMASHKDDEEKFFPQSGVLIFGKQSAKAANAAIDEVMITDEEEIRTTNPVATEQYGSVSTNLQAGNAQAATADVN

SEQ ID NO: 1441 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSTTPGGNNNSNFSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1442 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQAGIKTMSALSFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 1443 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENGDKTNVEIDRVMITDEEEIRTTNPVATEQYGSVSTNLQAGNAQAATADVN

SEQ ID NO: 1444 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1445 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGRFFPQSGVLIFGKQGSEKTNVDIEKVMITDEEEIRTTNPVATEQYGSVSTNLQAGNAQAATADVN

SEQ ID NO: 1446 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDTDNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1447 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAPRNSAAVRDVH

SEQ ID NO: 1448 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTKRANAEVDQVMITDEEEIRTTNPVATEQYGSVSTNLQAGNAQAATADVN

SEQ ID NO: 1449 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGQRDGAATRNVA

SEQ ID NO: 1450 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDNDRFFPQSGVLIFGKEGTGANNAEIGEVMITDEEEIRTTNPVATEQYGSVSTNLQAGNAQAATADVN

SEQ ID NO: 1451 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRHSPAASEGVH

SEQ ID NO: 1452 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSKKYTDNNNSNFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 1453 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 1454 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1455 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDNEKFFPQSGVLIFGKQGSEKTNVDIEKVMITDEEEIRTTNPVATEQYGSVSTNLQAGNAQAATADVN

SEQ ID NO: 1456 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNATGRPTKSALRFSQAGASDIRDQSRNWLPGPCYRQQRVSKVSADNNNSEFSWTGATKYHLNGRDSLVNPGPAMASHKDDEEKFFPQSGVLIFGKQGAGTTDVEYGQVMITDEEEIRTTNPVATEQYGSVSTNLQAGNAQAATADVN

SEQ ID NO: 1457 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKGKFFPQSGVLIFGKQGSEKTNVDIEKVMITDEEEIRTTNPVATEQYGSVSTNLQAGNAQAATADVN

SEQ ID NO: 1458 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEGADRNNVDIGSVMITDEEEIRTTNPVATEQYGSVSTNLQAGNAQAATADVN

SEQ ID NO: 1459 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNQTKSELHFSQAGASDIRDQSRNWLPGPCYRQQRVSTTPADNNNSDFSWTGATKYHLNGRDSLVNPGPAMASHKDDDEKFFPQSGVLIFGKKNARASDAAVDQVMITDEEEIRTTNPVATEQYGSVSTNLQAGNAQAATADVN

SEQ ID NO: 1460 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGRVTISNLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1461 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTKTNSSLSFSQAGASDIRDQSRNWLPGPCYRQQRVSTQDSDNNNSNFSWTGATKYHLNGRDSLVNPGPAMASHKDDEEKFFPQSGVLIFGKEGAAAANVAFESVMITDEEEIRTTNPVATEQYGSVSTNLQAGNAQAATADVN

SEQ ID NO: 1462 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAPRNSAAVRDVH

SEQ ID NO: 1463 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHGDDNDRFFPQSGVLIFGKQGTGTSNVDYDSVMITDEEEIRTTNPVATEQYGSVSTNLQAGNAQAATADVN

SEQ ID NO: 1464 - protein, 334 aa, Artificial Sequence
  Synthetic
QTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGHMTPSRLQFSQAGASDIRDQSRNWLPGPCYRQQRVSTQASGNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1465 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQSGTQTLSKLVFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1466 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGKFFPQSGVLIFGKQNAAKTNADIDDVMITDEEEIRTTNPVATEQYGSVSTNLQAGNAQAATADVN

SEQ ID NO: 1467 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAAQNNNSNFSWTGATKYHLNGRDSLVNPGPAMASHKDDDDKFFPQSGVLIFGKEGAGKGDVEYEKVMITDEEEIRTTNPVATEQYGSVSTNLQAGNAQAATADVN

SEQ ID NO: 1468 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1469 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAASSQAATRVVN

SEQ ID NO: 1470 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSTKPSDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1471 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRSGPNTNSQLLFSQAGASDIRDQSRNWLPGPCYRQQRVSKKPADNNNSNFSWTGATKYHLNGRDSLVNPGPAMASHRDDNDKFFPQSGVLIFGKENTNKADAAIEEVMITDEEEIRTTNPVATEQYGSVSTNLQAGNAQAATADVN

SEQ ID NO: 1472 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTTGSHTTSTLGFSQAGASDIRDQSRNWLPGPCYRQQRVSTTPADNNNSDFSWTGATKYHLNGRDSLVNPGPAMASHKDDDEKFFPQSGVLIFGKQGAARSNVAFEQVMITDEEEIRTTNPVATEQYGSVSTNLQRGNRQAATADVN

SEQ ID NO: 1473 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGPITKSQLKFSQAGASDIRDQSRNWLPGPCYRQQRVSTQSTHNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1474 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHRDDAGKFFPQSGVLIFGKEGASGGNADIGSVMITDEEEIRTTNPVATEQYGSVSTNLQVGNAQAATADVN

SEQ ID NO: 1475 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGSMTNSGLRFSQAGASDIRDQSRNWLPGPCYRQQRVSKTDDDNNNSDFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 1476 - protein, 334 aa, Artificial Sequence; identical to SEQ ID NO: 430
  Synthetic

SEQ ID NO: 1477 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKENSKANNVDIGGVMITDEEEIRTTNPVATEQYGSVSTNLQAGNAQAATADVN

SEQ ID NO: 1478 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 1479 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKESGGTDNVDIDRVMITDEEEIRTTNPVATEQYGSVSTNLQAGNAQAATADVN

SEQ ID NO: 1480 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGSEKTNVDIEKVMITDEEEIRTTNPVATEQYGSVSTNLQRGNRQAATADVN

SEQ ID NO: 1481 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGTLTTSNLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1482 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDDDRFFPQSGVLIFGKQGSEKTNVDIEKVMITDEEEIRTTNPVATEQYGSVSTNLQNSRATAASAGVH

SEQ ID NO: 1483 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHAGITTKSHLHFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1484 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGESGQAAAEMVT

SEQ ID NO: 1485 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDERFFPQSGVLIFGKQGAGENNVAIGNVMITDEEEIRTTNPVATEQYGSVSTNLQAGNAQAATADVN

SEQ ID NO: 1486 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDAGKFFPQSGVLIFGKQNATGTNVDVGSVMITDEEEIRTTNPVATEQYGSVSTNLQAGNAQAATADVN

SEQ ID NO: 1487 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSTGGLHTTSRLRFSQAGASDIRDQSRNWLPGPCYRQQRVSKTDTDNNNSKFSWTGATTYHLNGRDSLVNPGPAMASHKDDEEKFFPQSGVLIFGKQNGSANNVAFGQVMITDEEEIRTTNPVATEQYGSVSTNLQAGNAQAATADVN

SEQ ID NO: 1488 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGASKNNVEIGQVMITDEEEIRTTNPVATEQYGSVSTNLQAGNAQAATADVN

SEQ ID NO: 1489 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 1490 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSSSGSLTKSELKFSQAGASDIRDQSRNWLPGPCYRQQRVSKTSADNNNSEYSWTGATKYHLNGRDSLVNPGPAMASHKDDEEKFFPQSGVLIFGKQDARAADADIEQVMITDEEEIRTTNPVATEQYGSVSTNLQAGNAQAATADVN

SEQ ID NO: 1491 - protein, 334 aa, Artificial Sequence; identical to SEQ ID NO: 391
  Synthetic

SEQ ID NO: 1492 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDAGRFFPQSGVLIFGKQGSEKTNVDIEKVMITDEEEIRTTNPVATEQYGSVSTNLQAGNAQAATADVN

SEQ ID NO: 1493 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGIVTTSELRFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1494 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRSGTVTTSNLVFSQAGASDIRDQSRNWLPGPCYRQQRVSKISADNNNSEYSWTGATKYHLNGRDSLVNPGPAMASHKDDEEKFFPQSGVLIFGKEGTAKGNVDIEGVMITDEEEIRTTNPVATEQYGSVSTNLQAGNAQAATADVN

SEQ ID NO: 1495 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRSGINTQSALRFSQAGASDIRDQSRNWLPGPCYRQQRVSKTDGENNNSDFSWTGATKYHLNGRDSLVNPGPAMASHEDDAGRFFPQSGVLIFGKQGSEKTNVDIEKVMITDEEEIRTTNPVATEQYGSVSTNLQAGNAQAATADVN

SEQ ID NO: 1496 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGHKTTSNLGFSQAGASDIRDQSRNWLPGPCYRQQRVSTTPTGNNNSDFSWTGATKYHLNGRDSLVNPGPAMASHKDDDDRFFPQSGVLIFGKQGAGKNNAAIGQVMITDEEEIRTTNPVATEQYGSVSTNLQAGNAQAATADVN

SEQ ID NO: 1497 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSPKNQAAAGSVH

SEQ ID NO: 1498 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1499 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTATRNNNSDFSWTGATKYHLNGRDSLVNPGPAMASHKDDEEKFFPQSGVLIFGKQGSGADNIAIEGVMITDEEEIRTTNPVATEQYGSVSTNLQAGNAQAATADVN

SEQ ID NO: 1500 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNKTMSRLQFSQAGASDIRDQSRNWLPGPCYRQQRVSKTSADNNNSEYSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1501 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNGGRETLSRLKFSQAGASDIRDQSRNWLPGPCYRQQRVSTQSTGNNNSNFSWTGATKYHLNGRDSLVNPGPAMASHKDDEEKFFPQSGVLIFGKQNSAGNDAAVDEVMITDEEEIRTTNPVATEQYGSVSTNLQAGNAQAATADVN

SEQ ID NO: 1502 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKEGGTKGNTDIGHVMITDEEEIRTTNPVATEQYGSVSTNLQAGNAQAATADVN

SEQ ID NO: 1503 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAHGGHLTTSPLRFSQAGASDIRDQSRNWLPGPCYRQQRVSKTSTENNNSEFSWTGATTYHLNGRDSLVNPGPAMASHKDDNGRFFPQSGVLIFGKQGANRDNADIDQVMITDEEEIRTTNPVATEQYGSVSTNLQAGNAQAATADVN

SEQ ID NO: 1504 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRTGTATQSTLNFSQAGASDIRDQSRNWLPGPCYRQQRVSKTAARNNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1505 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSKTDNHNNNSNFSWTGATKYHLNGRDSLVNPGPAMASHRDDEGKFFPQSGVLIFGKQGSEKTNVDIEKVMITDEEEIRTTNPVATEQYGSVSTNLQAGNAQAATADVN

SEQ ID NO: 1506 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRTGLATLSGLKFSQAGASDIRDQSRNWLPGPCYRQQRVSKTDGENNNSDFSWTGATKYHLNGRDSLVNPGPAMASHRDDDDKFFPQSGVLIFGKEGAAANDVEYGHVMITDEEEIRTTNPVATEQYGSVSTNLQAGNAQAATADVN

SEQ ID NO: 1507 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQNAGEGNVDVDSVMITDEEEIRTTNPVATEQYGSVSTNLQAGNAQAATADVN

SEQ ID NO: 1508 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPDQNNNSDFSWTGATKYHLNGRDSLVNPGPAMASHRDDEDRFFPQSGVLIFGKQSARGANADYDDVMITDEEEIRTTNPVATEQYGSVSTNLQAGNAQAATADVN

SEQ ID NO: 1509 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDGGRGNAAIEQVMITDEEEIRTTNPVATEQYGSVSTNLQAGNAQAATADVN

SEQ ID NO: 1510 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNATTGNVTTSKLSFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 1511 - protein, 334 aa, Artificial Sequence; identical to SEQ ID NO: 157
  Synthetic

SEQ ID NO: 1512 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1513 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDEEKFFPQSGVLIFGKQGARTADTEIDSVMITDEEEIRTTNPVATEQYGSVSTNLQAGNAQAATADVN

SEQ ID NO: 1514 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNKTMSRLQFSQAGASDIRDQSRNWLPGPCYRQQRVSKTDGENNNSDFSWTGATKYHLNGRDSLVNPGPAMASHKDDEEKFFPQSGVLIFGKQDAGRNNIAIDGVMITDEEEIRTTNPVATEQYGSVSTNLQAGNAQAATADVN

SEQ ID NO: 1515 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESGRANDADIESVMITDEEEIRTTNPVATEQYGSVSTNLQAGNAQAATADVN

SEQ ID NO: 1516 - protein, 334 aa, Artificial Sequence; identical to SEQ ID NO: 150
  Synthetic

SEQ ID NO: 1517 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGTDKNNVDVGQVMITDEEEIRTTNPVATEQYGSVSTNLQAGNAQAATADVN

SEQ ID NO: 1518 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 1519 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRGPAADGEVH

SEQ ID NO: 1520 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQNTGTANVEIEKVMITDEEEIRTTNPVATEQYGSVSTNLQAGNAQAATADVN

SEQ ID NO: 1521 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNDTTSNLRFSQAGASDIRDQSRNWLPGPCYRQQRVSKVSADNNNSEFSWTGATKYHLNGRDSLVNPGPAMASHKDDEEKFFPQSGVLIFGKENGGTNNVEIGNVMITDEEEIRTTNPVATEQYGSVSTNLQAGNAQAATADVN

SEQ ID NO: 1522 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHRDDDGRFFPQSGVLIFGKENGGGSDAEIDDVMITDEEEIRTTNPVATEQYGSVSTNLQAGNAQAATADVN

SEQ ID NO: 1523 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGARGADAEIESVMITDEEEIRTTNPVATEQYGSVSTNLQAGNAQAATADVN

SEQ ID NO: 1524 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 1525 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKQNGSTTNVDIGGVMITDEEEIRTTNPVATEQYGSVSTNLQAGNAQAATADVN

SEQ ID NO: 1526 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSITMSGLRFSQAGASDIRDQSRNWLPGPCYRQQRVSKQPNDNNNSDFSWTGATKYHLNGRDSLVNPGPAMASHKDDDEKFFPQSGVLIFGKQGTGTSNVDYGSVMITDEEEIRTTNPVATEQYGSVSTNLQAGNAQAATADVN

SEQ ID NO: 1527 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDEDKFFPQSGVLIFGKEGARANNIEVDQVMITDEEEIRTTNPVATEQYGSVSTNLQAGNAQAATADVN

SEQ ID NO: 1528 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKHGGNNNSNFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1529 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDATGNLTHSQLLFSQAGASDIRDQSRNWLPGPCYRQQRVSKTSADNNNSEFSWTGATTYHLNGRDSLVNPGPAMASHKDDDGKFFPQSGVLIFGKQGSEKTNVDIEKVMITDEEEIRTTNPVATEQYGSVSTNLQRGNRQAATADVN

SEQ ID NO: 1530 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDEDKFFPQSGVLIFGKQDGSGDNIAIDGVMITDEEEIRTTNPVATEQYGSVSTNLQAGNAQAATADVN

SEQ ID NO: 1531 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAHADAAFHVVD

SEQ ID NO: 1532 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQRGNRQAATADVN

SEQ ID NO: 1533 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 1534 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGSEKTNVDIEKVMITDEEEIRTTNPVATEQYGSVSTNLQRGNRQAATADVN

SEQ ID NO: 1535 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKVSADNNNSEFSWTGATKYHLNGRDSLVNPGPAMASHKDDEEKFFPQSGVLIFGKENGREGNAAIEHVMITDEEEIRTTNPVATEQYGSVSTNLQAGNAQAATADVN

SEQ ID NO: 1536 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQGQKDRAASTDVH

SEQ ID NO: 1537 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSRNNNSEFSWTGATTYHLNGRDSLVNPGPAMASHKDDDEKFFPQSGVLIFGKQDAGKSNADIDRVMITDEEEIRTTNPVATEQYGSVSTNLQAGNAQAATADVN

SEQ ID NO: 1538 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDADKFFPQSGVLIFGKQNARKANIDIGEVMITDEEEIRTTNPVATEQYGSVSTNLQAGNAQAATADVN

SEQ ID NO: 1539 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEGTRKNNVDIEQVMITDEEEIRTTNPVATEQYGSVSTNLQAGNAQAATADVN

SEQ ID NO: 1540 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPARNNNSNFSWTGATTYHLNGRDSLVNPGPAMASHRDDEDKFFPQSGVLIFGKQGAEGTNVAYDKVMITDEEEIRTTNPVATEQYGSVSTNLQAGNAQAATADVN

SEQ ID NO: 1541 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGLVTLSRLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1542 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGHKTPSNLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1543 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGRTTMSGLRFSQAGASDIRDQSRNWLPGPCYRQQRVSTQSTQNNNSEFSWTGATKYHLNGRDSLVNPGPAMASHRDDAEKFFPQSGVLIFGKEGARGNNIDIDEVMITDEEEIRTTNPVATEQYGSVSTNLQAGNAQAATADVN

SEQ ID NO: 1544 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEGRFFPQSGVLIFGKQGSEKTNVDIEKVMITDEEEIRTTNPVATEQYGSVSTNLQAGNAQAATADVN

SEQ ID NO: 1545 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKQGSEKTNVDIEKVMITDEEEIRTTNPVATEQYGSVSTNLQRGNRQAATADVN

SEQ ID NO: 1546 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEGAGGTDIDIGHVMITDEEEIRTTNPVATEQYGSVSTNLQAGNAQAATADVN

SEQ ID NO: 1547 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDEGKFFPQSGVLIFGKESTARNNADVEQVMITDEEEIRTTNPVATEQYGSVSTNLQAGNAQAATADVN

SEQ ID NO: 1548 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKTSADNNNSEYSWTGATKYHLNGRDSLVNPGPAMASHRDDEGKFFPQSGVLIFGKESGGETNVDIGGVMITDEEEIRTTNPVATEQYGSVSTNLQAGNAQAATADVN

SEQ ID NO: 1549 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 1550 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARQNGPAAATVE

SEQ ID NO: 1551 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPKTAAAAHSVE

SEQ ID NO: 1552 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGNMTKSTLEFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 1553 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQDTSGANIDVDQVMITDEEEIRTTNPVATEQYGSVSTNLQAGNAQAATADVN

SEQ ID NO: 1554 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRDRSTAAVQGVH

SEQ ID NO: 1555 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGSVTQSHLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1556 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDTDNNNSEFSWTGATTYHLNGRDSLVNPGPAMASHKDDTERFFPQSGVLIFGKQGSEKTNVDIEKVMITDEEEIRTTNPVATEQYGSVSTNLQAGNAQAATADVN

SEQ ID NO: 1557 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGASSNAAATVVE

SEQ ID NO: 1558 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRQSGAASRDVP

SEQ ID NO: 1559 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKENAGGDNVEIERVMITDEEEIRTTNPVATEQYGSVSTNLQAGNAQAATADVN

SEQ ID NO: 1560 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKESAKTADAAVDDVMITDEEEIRTTNPVATEQYGSVSTNLQAGNAQAATADVN

SEQ ID NO: 1561 - protein, 334 aa, Artificial Sequence; identical to SEQ ID NO: 310
  Synthetic

SEQ ID NO: 1562 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 1563 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGRFFPQSGVLIFGKQGAGKDDVDIGGVMITDEEEIRTTNPVATEQYGSVSTNLQAGNAQAATADVN

SEQ ID NO: 1564 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNGSTTNVDIGGVMITDEEEIRTTNPVATEQYGSVSTNLQAGNAQAATADVN

SEQ ID NO: 1565 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGLTTMSKLRFSQAGASDIRDQSRNWLPGPCYRQQRVSKTHTGNNNSDFSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1566 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGHTTQSRLLFSQAGASDIRDQSRNWLPGPCYRQQRVSKQDAENNNSEFSWPGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1567 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTHGDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1568 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARSGIETISGLRFSQAGASDIRDQSRNWLPGPCYRQQRVSTTPDHNNNSDFSWTGATTYHLNGRDSLVNPGPAMASHRDDEGKFFPQSGVLIFGKQGATTDDVDVDGVMITDEEEIRTTNPVATEQYGSVSTNLQAGNAQAATADVN

SEQ ID NO: 1569 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKEGAARSNVDYEHVMITDEEEIRTTNPVATEQYGSVSTNLQAGNAQAATADVN

SEQ ID NO: 1570 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTSGNITKSSLMFSQAGASDIRDQSRNWLPGPCYRQQRVSKQHTHNNNSNFSWTGATTYHLNGRDSLVNPGPAMASHKDDADRFFPQSGVLIFGKQGASTTNAAIEDVMITDEEEIRTTNPVATEQYGSVSTNLQAGNAQAATADVN

SEQ ID NO: 1571 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGHKTNSGLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1572 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSTQPARNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 1573 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNNTISSLGFSQAGASDIRDQSRNWLPGPCYRQQRVSKPPNDNNNSEFSWTGATKYHLNGRDSLVNPGPAMASHRDDAEKFFPQSGVLIFGKQNAGASDADFDQVMITDEEEIRTTNPVATEQYGSVSTNLQAGNAQAATADVN

SEQ ID NO: 1574 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKEGAGANDVAVEHVMITDEEEIRTTNPVATEQYGSVSTNLQAGNAQAATADVN

SEQ ID NO: 1575 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDAGAANVEFGQVMITDEEEIRTTNPVATEQYGSVSTNLQAGNAQAATADVN

SEQ ID NO: 1576 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKDRAAAAVHNVH

SEQ ID NO: 1577 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNTGRPTTSSLMFSQAGASDIRDQSRNWLPGPCYRQQRVSKQSGQNNNSDFSWTGATKYHLNGRDSLVNPGPAMASHKDDEDKFFPQSGVLIFGKEGAAANNVEIDGVMITDEEEIRTTNPVATEQYGSVSTNLQAGNAQAATADVN

SEQ ID NO: 1578 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKEGAAANNVEIDGVMITDEEEIRTTNPVATEQYGSVSTNLQAGNAQAATADVN

SEQ ID NO: 1579 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 1580 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKTAADNNNSDFSWTGATKYHLNGRDSLVNPGPAMASHKDDDGKFFPQSGVLIFGKEGAGKGDVEYEKVMITDEEEIRTTNPVATEQYGSVSTNLQAGNAQAATADVN

SEQ ID NO: 1581 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKEGSEKTNVDIEKVMITDEEEIRTTNPVATEQYGSVSTNLQAGNAQAATADVN

SEQ ID NO: 1582 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSTTPADNNNSDFSWTGATKYHLNGRDSLVNPGPAMASHKDDEDKFFPQSGVLIFGKQDAGKANIDIDGVMITDEEEIRTTNPVATEQYGSVSTNLQAGNAQAATADVN

SEQ ID NO: 1583 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKEGASTANVAIGQVMITDEEEIRTTNPVATEQYGSVSTNLQAGNAQAATADVN

SEQ ID NO: 1584 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGRVTTSGLSFSQAGASDIRDQSRNWLPGPCYRQQRVSKTDGENNNSDFSWTGATKYHLNGRDSLVNPGPAMASHKDDEEKFFPQSGVLIFGKEDAGKTNIDIGQVMITDEEEIRTTNPVATEQYGSVSTNLQAGNAQAATADVN

SEQ ID NO: 1585 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKENSGTTNAAIGDVMITDEEEIRTTNPVATEQYGSVSTNLQAGNAQAATADVN

SEQ ID NO: 1586 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNITKSELRFSQAGASDIRDQSRNWLPGPCYRQQRVSTTPGGNNNSNFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 1587 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKAGSTTLSELRFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 1588 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1589 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAKKADTDIGNVMITDEEEIRTTNPVATEQYGSVSTNLQAGNAQAATADVN

SEQ ID NO: 1590 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGPMTLSRLQFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 1591 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSHRTAAASTAVA

SEQ ID NO: 1592 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSDSGITTHSDLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1593 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSDSGHPTLSQLKFSQAGASDIRDQSRNWLPGPCYRQQRVSKTSADNNNSNFSWTGATKYHLNGRDSLVNPGPAMASHRDDEDKFFPQSGVLIFGKENAAATDVDFGHVMITDEEEIRTTNPVATEQYGSVSTNLQAGNAQAATADVN

SEQ ID NO: 1594 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 1595 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASAGSVTHSTLGFSQAGASDIRDQSRNWLPGPCYRQQRVSKVSADNNNSEFSWTGATKYHLNGRDSLVNPGPAMASHKDDEEKFFPQSGVLIFGKEGAAGANIAIGEVMITDEEEIRTTNPVATEQYGSVSTNLQAGNAQAATADVN

SEQ ID NO: 1596 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGINTLSTLQFSQAGASDIRDQSRNWLPGPCYRQQRVSKQSADNNNSDFSWTGATKYHLNGRDSLVNPGPAMASHKDDDDRFFPQSGVLIFGKQGSGADNIAIEGVMITDEEEIRTTNPVATEQYGSVSTNLQAGNAQAATEDVN

SEQ ID NO: 1597 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNETGNATPSRLKFSQAGASDIRDQSRNWLPGPCYRQQRVSKTSADNNNSEYSWTGATKYHLNGRDSLVNPGPAMASHKDDEEKFFPQSGVLIFGKEGASTTDAAVEQVMITDEEEIRTTNPVATEQYGSVSTNLQAGNAQAATADVN

SEQ ID NO: 1598 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNATTSRLMFSQAGASDIRDQSRNWLPGPCYRQQRVSTQSTGNNNSDFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 1599 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKEHTRAAVNDVD

SEQ ID NO: 1600 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGLTTMSRLGFSQAGASDIRDQSRNWLPGPCYRQQRVSKVSADNNNSEFSWTGATKYHLNGRDSLVNPGPAMASHKDDDDRFFPQSGVLIFGKEGSEKTNVDIEKVMITDEEEIRTTNPVATEQYGSVSTNLQAGNAQAATADVN

SEQ ID NO: 1601 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSTKNNTDIERVMITDEEEIRTTNPVATEQYGSVSTNLQAGNAQAATADVN

SEQ ID NO: 1602 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEDAGAANVEFGQVMITDEEEIRTTNPVATEQYGSVSTNLQAGNAQAATADVN

SEQ ID NO: 1603 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGGTEGDADIDKVMITDEEEIRTTNPVATEQYGSVSTNLQAGNAQAATADVN

SEQ ID NO: 1604 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAHATAAVRDVT

SEQ ID NO: 1605 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKTSADNNNSNFSWTGATKYHLNGRDSLVNPGPAMASHRDDEDKFFPQSGVLIFGKQDTGKGDVAIEHVMITDEEEIRTTNPVATEQYGSVSTNLQAGNAQAATADVN

SEQ ID NO: 1606 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKASDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 1607 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDQSDSAAITIVH

SEQ ID NO: 1608 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGILTQSTLRFSQAGASDIRDQSRNWLPGPCYRQQRVSKVSADNNNSEFSWTGATKYHLNGRDSLVNPGPAMASHKDDDDKFFPQSGVLIFGKESTSTANVEIEKVMITDEEEIRTTNPVATEQYGSVSTNLQAGNAQAATADVN

SEQ ID NO: 1609 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGPATLSTLKFSQAGASDIRDQSRNWLPGPCYRQQRVSTKATDNNNSNFSWTGATKYHLNGRDSLVNPGPAMASHKDDDDKFFPQSGVLIFGKEGSGGNDVDIERVMITDEEEIRTTNPVATEQYGSVSTNLQAGNAQAATADVN

SEQ ID NO: 1610 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTARNGAAVREVH

SEQ ID NO: 1611 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGLTTLSKLGFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1612 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHEDDNGKFFPQSGVLIFGKQGSEKTNVDIEKVMITDEEEIRTTNPVATEQYGSVSTNLQAGNAQAATADVN

SEQ ID NO: 1613 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDRFFPQSGVLIFGKEGARAANIDIGQVMITDEEEIRTTNPVATEQYGSVSTNLQAGNAQAATADVN

SEQ ID NO: 1614 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKQSADNNNSDFSWTGATKYHLNGRDSLVNPGPAMASHGDDKGRFFPQSGVLIFGKEDAGTTNVAFDKVMITDEEEIRTTNPVATEQYGSVSTNLQAGNAQAATADVN

SEQ ID NO: 1615 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGNHTTSDLRFSQAGASDIRDQSRNWLPGPCYRQQRVSTKDTDNNNSNFSWTGATKYHLNGRDSLVNPGPAMASHKDDDDRFFPQSGVLIFGKEGAAASDVEYGEVMITDEEEIRTTNPVATEQYGSVSTNLQAGNAQAATADVN

SEQ ID NO: 1616 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQGGSNTKSGLKFSQAGASDIRDQSRNWLPGPCYRQQRVSKTSADNNNSDFSWTGATKYHLNGRDSLVNPGPAMASHKDDDEKFFPQSGVLIFGKENAATNNAAIDEVMITDEEEIRTTNPVATEQYGSVSTNLQAGNAQAATADVN

SEQ ID NO: 1617 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTDDDNNNSDFSWTGATKYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 1618 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 1619 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRPQGEAATEEVP

SEQ ID NO: 1620 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPANGNNNSEFSWTGATKYHLNGRDSLVNPGPAMASHKDDDDRFFPQSGVLIFGKQDAGKANIDIDGVMITDEEEIRTTNPVATEQYGSVSTNLQAGNAQAATADVN

SEQ ID NO: 1621 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGSTATDVDIGRVMITDEEEIRTTNPVATEQYGSVSTNLQAGNAQAATADVN

SEQ ID NO: 1622 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQDTGRNNVEIDSVMITDEEEIRTTNPVATEQYGSVSTNLQAGNAQAATADVN

SEQ ID NO: 1623 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGNVTLSDLQFSQAGASDIRDQSRNWLPGPCYRQQRVSKQSDRNNNSEFSWTGATKYHLNGRDSLVNPGPAMASHKDDDGRFFPQSGVLIFGKEGATGTNVAIGKVMITDEEEIRTTNPVATEQYGSVSTNLQAGNAQAATADVN

SEQ ID NO: 1624 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSSGRATPSALSFSQAGASDIRDQSRNWLPGPCYRQQRVSKQPSQNNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1625 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAGRNNTDIDDVMITDEEEIRTTNPVATEQYGSVSTNLQAGNAQAATADVN

SEQ ID NO: 1626 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGLDTTSRLRFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 1627 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPRGGAAVQKVA

SEQ ID NO: 1628 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENASGDNVEVDSVMITDEEEIRTTNPVATEQYGSVSTNLQAGNAQAATADVN

SEQ ID NO: 1629 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNKTPSPLNFSQAGASDIRDQSRNWLPGPCYRQQRVSKQSDRNNNSEFSWTGATKYHLNGRDSLVNPGPAMASHKDDEDKFFPQSGVLIFGKQGASTTNAAIEDVMITDEEEIRTTNPVATEQYGSVSTNLQAGNAQAATADVN

SEQ ID NO: 1630 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEARGPAAIQKVD

SEQ ID NO: 1631 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGSPTKSRLGFSQAGASDIRDQSRNWLPGPCYRQQRVSKTSADNNNSDFSWTGATKYHLNGRDSLVNPGPAMASHKDDEEKFFPQSGVLIFGKQDSGGTNVDIGHVMITDEEEIRTTNPVATEQYGSVSTNLQAGNAQAATADVN

SEQ ID NO: 1632 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGPQTTSTLRFSQAGASDIRDQSRNWLPGPCYRQQRVSKQSDHNNNSNFSWTGATKYHLNGRDSLVNPGPAMASHKDDDDKFFPQSGVLIFGKENGSGGDVAIDNVMITDEEEIRTTNPVATEQYGSVSTNLQAGNAQAATADVN

SEQ ID NO: 1633 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 1634 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGGTAGNVDVEGVMITDEEEIRTTNPVATEQYGSVSTNLQAGNAQAATADVN

SEQ ID NO: 1635 - protein, 334 aa, Artificial Sequence; identical to SEQ ID NO: 427
  Synthetic

SEQ ID NO: 1636 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 1637 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTKTNSSLSFSQAGASDIRDQSRNWLPGPCYRQQRVSKTAADNNNSDFSWTGATTYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 1638 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSGGHPTTSALLFSQAGASDIRDQSRNWLPGPCYRQQRVSKKYTDNNNSNFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1639 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATKYHLNGRDSLVNPGPAMASHEDDKDKFFPQSGVLIFGKQGSEKTNVDIEKVMITDEEEIRTTNPVATEQYGSVSTNLQAGNAQAATADVN

SEQ ID NO: 1640 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGPATKSALGFSQAGASDIRDQSRNWLPGPCYRQQRVSTQSTGNNNSDFSWTGATKYHLNGRDSLVNPGPAMASHKDDDDRFFPQSGVLIFGKQGATRDNTDIGHVMITDEEEIRTTNPVATEQYGSVSTNLQAGNAQAATADVN

SEQ ID NO: 1641 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGHPTKSRLVFSQAGASDIRDQSRNWLPGPCYRQQRVSKVSADNNNSEFSWTGATKYHLNGRDSLVNPGPAMASHRDDEGKFFPQSGVLIFGKEGSAASNVDIGGVMITDEEEIRTTNPVATEQYGSVSTNLQAGNAQAATADVN

SEQ ID NO: 1642 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATTYHLNGRDSLVNPGPAMASHGDDNEKFFPQSGVLIFGKEDSEKTNVDIEKVMITDEEEIRTTNPVATEQYGSVSTNLQAGNAQAATADVN

SEQ ID NO: 1643 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDERFFPQSGVLIFGKQSGKRANVEIDQVMITDEEEIRTTNPVATEQYGSVSTNLQAGNAQAATADVN

SEQ ID NO: 1644 - protein, 334 aa, Artificial Sequence
  Synthetic
NSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGTVTLSNLRFSQAGASDIRDQSRNWLPGPCYRQQRVSTQDGQNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 1645 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSNFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 1646 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1647 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHVTQSRLLFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1648 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTKDDRNNNSDFSWTGATKYHLNGRDSLVNPGPAMASHEDDAGKFFPQSGVLIFGKQGSEKTNVDIEKVMITDEEEIRTTNPVATEQYGSVSTNLQRGNRQAATADVN

SEQ ID NO: 1649 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRNGAAVTMVQ

SEQ ID NO: 1650 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQTGPTTLSQLRFSQAGASDIRDQSRNWLPGPCYRQQRVSKTPNDNNNSNFSWTGATKYHLNGRDSLVNPGPAMASHRDDEDKFFPQSGVLIFGKQDGNGANVEIEGVMITDEEEIRTTNPVATEQYGSVSTNLQAGNAQAATADVN

SEQ ID NO: 1651 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQATRAPAADTRVD

SEQ ID NO: 1652 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSKKTAAAVETVA

SEQ ID NO: 1653 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDKFFPQSGVLIFGKQNAAKANVDIGDVMITDEEEIRTTNPVATEQYGSVSTNLQAGNAQAATADVN

SEQ ID NO: 1654 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSKKYTDNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1655 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGRNTTSTLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1656 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSRQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 1657 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEDAGTTNVAFDKVMITDEEEIRTTNPVATEQYGSVSTNLQAGNAQAATADVN

SEQ ID NO: 1658 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKENSGTNNAEIDNVMITDEEEIRTTNPVATEQYGSVSTNLQAGNAQAATADVN

SEQ ID NO: 1659 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDNGRFFPQSGVLIFGKQDAGKANIDIDGVMITDEEEIRTTNPVATEQYGSVSTNLQAGNAQAATADVN

SEQ ID NO: 1660 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKEGSEKNDVEFEQVMITDEEEIRTTNPVATEQYGSVSTNLQAGNAQAATADVN

SEQ ID NO: 1661 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNKTMSALRFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQRGNRQAATADVN

SEQ ID NO: 1662 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSELRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1663 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGSHTTSALRFSQAGASDIRDQSRNWLPGPCYRQQRVSTTPADNNNSDFSWTGATKYHLNGRDSLVNPGPAMASHKDDDDRFFPQSGVLIFGKEDGAATDAAIDEVMITDEEEIRTTNPVATEQYGSVSTNLQAGNAQAATADVN

SEQ ID NO: 1664 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHVDDDDKFFPQSGVLIFGKQGSEKTNVDIEKVMITDEEEIRTTNPVATEQYGSVSTNLQRGNRQAATADVN

SEQ ID NO: 1665 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSRSGNETMSRLSFSQAGASDIRDQSRNWLPGPCYRQQRVSKTSADNNNSNFSWTGATKYHLNGRDSLVNPGPAMASHRDDAGKFFPQSGVLIFGKQSASKNNIAIEEVMITDEEEIRTTNPVATEQYGSVSTNLQAGNAQAATADVN

SEQ ID NO: 1666 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSNENNNSNFSWTGATTYHLNGRDSLVNPGPAMASHKDDDDKFFPQSGVLIFGKQNAGKDNVAFDGVMITDEEEIRTTNPVATEQYGSVSTNLQAGNAQAATADVN

SEQ ID NO: 1667 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKGKFFPQSGVLIFGKQGSEKTNVDIEKVMITDEEEIRTTNPVATEQYGSVSTNLQAGNAQAATADVN

SEQ ID NO: 1668 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGSETNSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1669 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDTGKFFPQSGVLIFGKQGSEKTNVDIEKVMITDEEEIRTTNPVATEQYGSVSTNLQRGNRQAATADVN

SEQ ID NO: 1670 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESAGKTNTEYDKVMITDEEEIRTTNPVATEQYGSVSTNLQAGNAQAATADVN

SEQ ID NO: 1671 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNAGTKTQSKLQFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 1672 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTSGNQTKSGLRFSQAGASDIRDQSRNWLPGPCYRQQRVSKQHNQNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 1673 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1674 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHAGHDTTSRLIFSQAGASDIRDQSRNWLPGPCYRQQRVSKQSSDNNNSEFSWTGATKYHLNGRDSLVNPGPAMASHKDDDDRFFPQSGVLIFGKESGSGADVDIGRVMITDEEEIRTTNPVATEQYGSVSTNLQAGNAQAATADVN

SEQ ID NO: 1675 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 1676 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGRFFPQSGVLIFGKQSSGKSNIAIEGVMITDEEEIRTTNPVATEQYGSVSTNLQAGNAQAATADVN

SEQ ID NO: 1677 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNSGILTTSTLRFSQAGASDIRDQSRNWLPGPCYRQQRVSKQPSQNNNSNFSWTGATKYHLNGRDSLVNPGPAMASHGDDEGRFFPQSGVLIFGKQGSEKTNVDIEKVMITDEEEIRTTNPVATEQYGSVSTNLQAGNAQAATADVN

SEQ ID NO: 1678 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGHNTTSGLRFSQAGASDIRDQSRNWLPGPCYRQQRVSKPPDRNNNSDFSWTGATKYHLNGRDSLVNPGPAMASHRDDDDKFFPQSGVLIFGKQSASGSDVAIDEVMITDEEEIRTTNPVATEQYGSVSTNLQAGNAQAATADVN

SEQ ID NO: 1679 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGRTTMSGLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1680 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGTRRDNADFDGVMITDEEEIRTTNPVATEQYGSVSTNLQAGNAQAATADVN

SEQ ID NO: 1681 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRKNTSSGPMTTSSLKFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQRGNRQAATADVN

SEQ ID NO: 1682 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGRPTQSDLGFSQAGASDIRDQSRNWLPGPCYRQQRVSTTSNENNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1683 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQERKGTAATRDVD

SEQ ID NO: 1684 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDGKGSNIAIEGVMITDEEEIRTTNPVATEQYGSVSTNLQAGNAQAATADVN

SEQ ID NO: 1685 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQHNGNNNSNFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 1686 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRAAAAFDGVQ

SEQ ID NO: 1687 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGSMTLSRLRFSQAGASDIRDQSRNWLPGPCYRQQRVSKTSADNNNSNFSWTGATKYHLNGRDSLVNPGPAMASHRDDEDKFFPQSGVLIFGKEDTGKANVDIGNVMITDEEEIRTTNPVATEQYGSVSTNLQAGNAQAATADVN

SEQ ID NO: 1688 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSNFSWTGATKYHLNGRDSLVNPGPAMASHRDDEEKFFPQSGVLIFGKQGSEKTNVDIEKVMITDEEEIRTTNPVATEQYGSVSTNLQRGNRQAATADVN

SEQ ID NO: 1689 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGGGANDVAVEQVMITDEEEIRTTNPVATEQYGSVSTNLQAGNAQAATADVN

SEQ ID NO: 1690 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSNFSWTGATKYHLNGRDSLVNPGPAMASHKDDEDKFFPQSGVLIFGKQDAEEGNVDIGRVMITDEEEIRTTNPVATEQYGSVSTNLQAGNAQAATADVN

SEQ ID NO: 1691 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGTKTTSELLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1692 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPGGNNNSNFSWTGATKYHLNGRDSLVNPGPAMASHKDDEDKFFPQSGVLIFGKENSRAGNVDIEEVMITDEEEIRTTNPVATEQYGSVSTNLQAGNAQAATADVN

SEQ ID NO: 1693 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDDRNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1694 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKESGGANNVEYDGVMITDEEEIRTTNPVATEQYGSVSTNLQAGNAQAATADVN

SEQ ID NO: 1695 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGARETNVEIDQVMITDEEEIRTTNPVATEQYGSVSTNLQRGNRQAATADVN

SEQ ID NO: 1696 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKGGNLTQSQLSFSQAGASDIRDQSRNWLPGPCYRQQRVSTQPTDNNNSEFSWTGATKYHLNGRDSLVNPGPAMASHKDDNEKFFPQSGVLIFGKQSAKAANAAIDEVMITDEEEIRTTNPVATEQYGSVSTNLQAGNAQAATADVN

SEQ ID NO: 1697 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSTTPADNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 1698 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGTKKTNAEIEDVMITDEEEIRTTNPVATEQYGSVSTNLQRGNRQAATADVN

SEQ ID NO: 1699 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKEGASTTNVEIGSVMITDEEEIRTTNPVATEQYGSVSTNLQAGNAQAATADVN

SEQ ID NO: 1700 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDEEKFFPQSGVLIFGKESTTEANVDIEKVMITDEEEIRTTNPVATEQYGSVSTNLQAGNAQAATADVN

SEQ ID NO: 1701 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRSTAAVRDVH

SEQ ID NO: 1702 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGARGADAEIESVMITDEEEIRTTNPVATEQYGSVSTNLQAGNAQAATADVN

SEQ ID NO: 1703 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRTNATAATSDVQ

SEQ ID NO: 1704 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGTLTTSNLRFSQAGASDIRDQSRNWLPGPCYRQQRVSTTPGGNNNSNFSWTGATKYHLNGRDSLVNPGPAMASHKDDDDKFFPQSGVLIFGKQNANRDDAEVGDVMITDEEEIRTTNPVATEQYGSVSTNLQAGNAQAATADVN

SEQ ID NO: 1705 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATKYHLNGRDSLVNPGPAMASHEDDTGKFFPQSGVLIFGKQGSEKTNVDIEKVMITDEEEIRTTNPVATEQYGSVSTNLQAGNAQAATADVN

SEQ ID NO: 1706 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGTNTLSRLLFSQAGASDIRDQSRNWLPGPCYRQQRVSKKSTGNNNSDFSWTGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 1707 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEGGTGTNVEVDKVMITDEEEIRTTNPVATEQYGSVSTNLQAGNAQAATADVN

SEQ ID NO: 1708 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGRDTPSSLRFSQAGASDIRDQSRNWLPGPCYRQQRVSKTSADNNNSEYSWTGATTYHLNGRDSLVNPGPAMASHKDDDDRFFPQSGVLIFGKESSAKSNVEFDSVMITDEEEIRTTNPVATEQYGSVSTNLQAGNAQAATADVN

SEQ ID NO: 1709 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGGMKSDAAVDDVMITDEEEIRTTNPVATEQYGSVSTNLQAGNAQAATADVN

SEQ ID NO: 1710 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKTSADNNNSNFSWTGATKYHLNGRDSLVNPGPAMASHRDDEDKFFPQSGVLIFGKEGANRTNIAIGEVMITDEEEIRTTNPVATEQYGSVSTNLQAGNAQAATADVN

SEQ ID NO: 1711 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGSRTAAANNEVD

SEQ ID NO: 1712 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGHTTISALRFSQAGASDIRDQSRNWLPGPCYRQQRVSKQANHNNNSEFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 1713 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGNDTKSPLKFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1714 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGNKTTSALVFSQAGASDIRDQSRNWLPGPCYRQQRVSTTYNHNNNSEFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 1715 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKQGAAGGNVAVEGVMITDEEEIRTTNPVATEQYGSVSTNLQAGNAQAATADVN

SEQ ID NO: 1716 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTETGHNTHSRLGFSQAGASDIRDQSRNWLPGPCYRQQRVSKQSDRNNNSEFSWTGATKYHLNGRDSLVNPGPAMASHKDDEDKFFPQSGVLIFGKEDAGKTNIDIGQVMITDEEEIRTTNPVATEQYGSVSTNLQAGNAQAATADVN

SEQ ID NO: 1717 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTHTRNNNSDFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1718 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESGNTNNVDVGEVMITDEEEIRTTNPVATEQYGSVSTNLQAGNAQAATADVN

SEQ ID NO: 1719 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKTSADNNNSEFSWTGATKYHLNGRDSLVNPGPAMASHKDDEEKFFPQSGVLIFGKQSASRNDVAVGEVMITDEEEIRTTNPVATEQYGSVSTNLQAGNAQAATADVN

SEQ ID NO: 1720 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTDGENNNSDFSWTGATKYHLNGRDSLVNPGPAMASHKDDEEKFFPQSGVLIFGKESARKTDAAIDDVMITDEEEIRTTNPVATEQYGSVSTNLQAGNAQAATADVN

SEQ ID NO: 1721 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKHGGNNNSNFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 1722 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGTETDNVDIENVMITDEEEIRTTNPVATEQYGSVSTNLQAGNAQAATADVN

SEQ ID NO: 1723 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGTRRDNADFDNVMITDEEEIRTTNPVATEQYGSVSTNLQAGNAQAATADVN

SEQ ID NO: 1724 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSKQASDNNNSEFSWTGATKYHLNGRDSLVNPGPAMASHKDDEEKFFPQSGVLIFGKQSSARGDIDIDNVMITDEEEIRTTNPVATEQYGSVSTNLQAGNAQAATADVN

SEQ ID NO: 1725 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDGKESNIEIGDVMITDEEEIRTTNPVATEQYGSVSTNLQAGNAQAATADVN

SEQ ID NO: 1726 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAQASAAAKVVN

SEQ ID NO: 1727 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKEGSEKNDVEFEQVMITDEEEIRTTNPVATEQYGSVSTNLQRGNRQAATADVN

SEQ ID NO: 1728 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDDGNNNSNFSWTGATKYHLNGRDSLVNPGPAMASHKDDEEKFFPQSGVLIFGKEGSRRANVDIEYVMITDEEEIRTTNPVATEQYGSVSTNLQAGNAQAATADVN

SEQ ID NO: 1729 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNTGSKTLSRLKFSQAGASDIRDQSRNWLPGPCYRQQRVSKQPNDNNNSEFSWTGATTYHLNGRDSLVNPGPAMASHKDDEEKFFPQSGVLIFGKQGAGANNVDIGGVMITDEEEIRTTNPVATEQYGSVSTNLQAGNAQAATADVN

SEQ ID NO: 1730 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGAGKNNAAIDQVMITDEEEIRTTNPVATEQYGSVSTNLQAGNAQAATADVN

SEQ ID NO: 1731 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKQDAGKSDVDIGGVMITDEEEIRTTNPVATEQYGSVSTNLQAGNAQAATADVN

SEQ ID NO: 1732 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSVTTTQSRLQFSQAGASDIRDQSRNWLPGPCYRQQRVSKTSADNNNSEYSWTGATKYHLNGRDSLVNPGPAMASHEDDAGKFFPQSGVLIFGKQGSEKTNVDIEKVMITDEEEIRTTNPVATEQYGSVSTNLQRGNRQAATADVN

SEQ ID NO: 1733 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGSRTGAANRDVA

SEQ ID NO: 1734 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDTAATNVEFEGVMITDEEEIRTTNPVATEQYGSVSTNLQAGNAQAATADVN

SEQ ID NO: 1735 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHRDDTDRFFPQSGVLIFGKQGSEKTNVDIEKVMITDEEEIRTTNPVATEQYGSVSTNLQAGNAQAATADVN

SEQ ID NO: 1736 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNAGGLATQSQLRFSQAGASDIRDQSRNWLPGPCYRQQRVSKTSADNNNSNFSWTGATKYHLNGRDSLVNPGPAMASHRDDEDKFFPQSGVLIFGKQGGTKTDAAYEEVMITDEEEIRTTNPVATEQYGSVSTNLQAGNAQAATADVN

SEQ ID NO: 1737 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDAERFFPQSGVLIFGKQGSEKTNVDIEKVMITDEEEIRTTNPVATEQYGSVSTNLQAGNAQAATADVN

SEQ ID NO: 1738 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASSGLETMSTLRFSQAGASDIRDQSRNWLPGPCYRQQRVSKQDTDNNNSEFSWTGATTYHLNGRDSLVNPGPAMASHKDDDEKFFPQSGVLIFGKQDSRTADVEIDHVMITDEEEIRTTNPVATEQYGSVSTNLQAGNAQAATADVN

SEQ ID NO: 1739 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKGKTQAATREVE

SEQ ID NO: 1740 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRQQGQAASTGVN

SEQ ID NO: 1741 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSTQHNHNNNSEFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1742 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSEFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 1743 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPSGPNTTSGLEFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1744 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQHNQNNNSEFSWTGATTYHLNGRDSLVNPGPAMASHKDDEGRFFPQSGVLIFGKENAGKSDVEIEHVMITDEEEIRTTNPVATEQYGSVSTNLQAGNAQAATADVN

SEQ ID NO: 1745 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTEGGLQTMSALKFSQAGASDIRDQSRNWLPGPCYRQQRVSTKAADNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATAVVN

SEQ ID NO: 1746 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQRAAAANANVT

SEQ ID NO: 1747 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGGGANNIAIGQVMITDEEEIRTTNPVATEQYGSVSTNLQAGNAQAATADVN

SEQ ID NO: 1748 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRRQSGAAFDMVD

SEQ ID NO: 1749 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGATGPNTHSHLGFSQAGASDIRDQSRNWLPGPCYRQQRVSKTDGENNNSDFSWTGATKYHLNGRDSLVNPGPAMASHKDDEEKFFPQSGVLIFGKESGRKGDIDIDDVMITDEEEIRTTNPVATEQYGSVSTNLQAGNAQAATADVN

SEQ ID NO: 1750 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWPGATTYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 1751 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1752 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGNETLSPLRFSQAGASDIRDQSRNWLPGPCYRQQRVSKQSDHNNNSNFSWTGATKYHLNGRDSLVNPGPAMASHKDDDDKFFPQSGVLIFGKQGSGTSNVEFEQVMITDEEEIRTTNPVATEQYGSVSTNLQAGNAQAATADVN

SEQ ID NO: 1753 - protein, 334 aa, Artificial Sequence; identical to SEQ ID NO: 41
  Synthetic

SEQ ID NO: 1754 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDADRFFPQSGVLIFGKQDSEKSNVAIGGVMITDEEEIRTTNPVATEQYGSVSTNLQAGNAQAATADVN

SEQ ID NO: 1755 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSRNNNSEFSWTGATTYHLNGRDSLVNPGPAMASHKDDDEKFFPQSGVLIFGKQDAGKSNADIDRVMITDEEEIRTTNPVATEQYGSVSTNLQAGNAQAATADVN

SEQ ID NO: 1756 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGPTTTSRLGFSQAGASDIRDQSRNWLPGPCYRQQRVSKTPNDNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1757 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNKTMSRLQFSQAGASDIRDQSRNWLPGPCYRQQRVSKQPSENNNSDFSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 1758 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKEDTEEGDIDIDRVMITDEEEIRTTNPVATEQYGSVSTNLQAGNAQAATADVN

SEQ ID NO: 1759 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGNTTISALKFSQAGASDIRDQSRNWLPGPCYRQQRVSKTSADNNNSEYSWTGATKYHLNGRDSLVNPGPAMASHKDDEEKFFPQSGVLIFGKENASGTNVDIGNVMITDEEEIRTTNPVATEQYGSVSTNLQAGNAQAATADVN

SEQ ID NO: 1760 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAAAADVN

SEQ ID NO: 1761 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1762 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKEDAGTTNVAFDKVMITDEEEIRTTNPVATEQYGSVSTNLQAGNAQAATADVN

SEQ ID NO: 1763 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGTNTLSRLLFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 1764 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTAGNVTLSRLMFSQAGASDIRDQSRNWLPGPCYRQQRVSKTDGENNNSDFSWTGATKYHLNGRDSLVNPGPAMASHKDDEDRFFPQSGVLIFGKQNAGASDADFDQVMITDEEEIRTTNPVATEQYGSVSTNLQRGNRQAATADVN

SEQ ID NO: 1765 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGSVTQSHLRFSQAGASDIRDQSRNWLPGPCYRQQRVSKQSDRNNNSEFSWTGATKYHLNGRDSLVNPGPAMASHKDDEDKFFPQSGVLIFGKQSAKAANAAIDEVMITDEEEIRTTNPVATEQYGSVSTNLQAGNAQAATADVN

SEQ ID NO: 1766 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSTQPNHNNNSEFSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 1767 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPHDDNNNSDFSWTGATTYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 1768 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKGRTAAAAAGVD

SEQ ID NO: 1769 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATTYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 1770 - protein, 334 aa, Artificial Sequence; identical to SEQ ID NO: 143
  Synthetic

SEQ ID NO: 1771 - protein, 334 aa, Artificial Sequence; identical to SEQ ID NO: 448
  Synthetic

SEQ ID NO: 1772 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDGGTTTKSQLRFSQAGASDIRDQSRNWLPGPCYRQQRVSKQSDRNNNSEFSWTGATKYHLNGRDSLVNPGPAMASHKDDEDKFFPQSGVLIFGKESAGATDVAIERVMITDEEEIRTTNPVATEQYGSVSTNLQAGNAQAATADVN

SEQ ID NO: 1773 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGTGKANIDIDKVMITDEEEIRTTNPVATEQYGSVSTNLQAGNAQAATADVN

SEQ ID NO: 1774 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKAGLDTPSDLRFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1775 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 1776 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQGGSTTLSRLGFSQAGASDIRDQSRNWLPGPCYRQQRVSKTPAGNNNSKFSWTGATKYHLNGRDSLVNPGPAMASHKDDDDRFFPQSGVLIFGKQNAGKDDVDIDQVMITDEEEIRTTNPVATEQYGSVSTNLQAGNAQAATADVN

SEQ ID NO: 1777 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGTGPMTKSKLGFSQAGASDIRDQSRNWLPGPCYRQQRVSKQDGHNNNSDFSWTGATTYHLNGRDSLVNPGPAMASHKDDDDKFFPQSGVLIFGKEGAGRNNTDIDDVMITDEEEIRTTNPVATEQYGSVSTNLQAGNAQAATADVN

SEQ ID NO: 1778 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQNGRKGNVAIEEVMITDEEEIRTTNPVATEQYGSVSTNLQAGNAQAATADVN

SEQ ID NO: 1779 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTAKGRAATTDVA

SEQ ID NO: 1780 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDAGTTNVAFDKVMITDEEEIRTTNPVATEQYGSVSTNLQAGNAQAATADVN

SEQ ID NO: 1781 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 1782 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQRGNRQAATADVN

SEQ ID NO: 1783 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGHATKSNLRFSQAGASDIRDQSRNWLPGPCYRQQRVSTTAGDNNNSNFSWTGATTYHLNGRDSLVNPGPAMASHRDDEDKFFPQSGVLIFGKQGGAGGDAEFEQVMITDEEEIRTTNPVATEQYGSVSTNLQAGNAQAATADVN

SEQ ID NO: 1784 - protein, 334 aa, Artificial Sequence
  Synthetic
DTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGLKTTSKLKFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1785 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDRFFPQSGVLIFGKQSGGRSNVAFGDVMITDEEEIRTTNPVATEQYGSVSTNLQAGNAQAATADVN

SEQ ID NO: 1786 - protein, 334 aa, Artificial Sequence; identical to SEQ ID NO: 412
  Synthetic

SEQ ID NO: 1787 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGTGTMTKSQLGFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1788 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1789 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGGRAADAAFEEVMITDEEEIRTTNPVATEQYGSVSTNLQAGNAQAATADVN

SEQ ID NO: 1790 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTSGHPTLSHLRFSQAGASDIRDQSRNWLPGPCYRQQRVSKQPGDNNNSNFSWTGATKYHLNGRDSLVNPGPAMASHKDDDDRFFPQSGVLIFGKQGTGASNADIDHVMITDEEEIRTTNPVATEQYGSVSTNLQAGNAQAATADVN

SEQ ID NO: 1791 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 1792 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNATGIMTTSHLRFSQAGASDIRDQSRNWLPGPCYRQQRVSKQDTDNNNSEFSWTGATTYHLNGRDSLVNPGPAMASHKDDDEKFFPQSGVLIFGKQNAGATDVDIGSVMITDEEEIRTTNPVATEQYGSVSTNLQAGNAQAATADVN

SEQ ID NO: 1793 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPRGQAANTTVD

SEQ ID NO: 1794 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNQTKSELHFSQAGASDIRDQSRNWLPGPCYRQQRVSKQSGQNNNSDFSWTGATKYHLNGRDSLVNPGPAMASHKDDEGKFFPQSGVLIFGKEGGAGSDVEIDKVMITDEEEIRTTNPVATEQYGSVSTNLQAGNAQAATADVN

SEQ ID NO: 1795 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGSPTKSRLGFSQAGASDIRDQSRNWLPGPCYRQQRVSKQPGDNNNSNFSWTGATKYHLNGRDSLVNPGPAMASHKDDDDRFFPQSGVLIFGKENGGGGNIDIGHVMITDEEEIRTTNPVATEQYGSVSTNLQAGNAQAATADVN

SEQ ID NO: 1796 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTANENNNSEFSWTGATKYHLNGRDSLVNPGPAMASHKDDDDRFFPQSGVLIFGKQGGDRNNAAIGEVMITDEEEIRTTNPVATEQYGSVSTNLQAGNAQAATADVN

SEQ ID NO: 1797 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSTQYNRNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1798 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNDKFFPQSGVLIFGKENAGASDIAIDHVMITDEEEIRTTNPVATEQYGSVSTNLQAGNAQAATADVN

SEQ ID NO: 1799 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANSGRHTQSELKFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1800 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQNAGEGNVDVDSVMITDEEEIRTTNPVATEQYGSVSTNLQAGNAQAATADVN

SEQ ID NO: 1801 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQGTTGANVAYEDVMITDEEEIRTTNPVATEQYGSVSTNLQAGNAQAATADVN

SEQ ID NO: 1802 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQGASKTNIDIGKVMITDEEEIRTTNPVATEQYGSVSTNLQAGNAQAATADVN

SEQ ID NO: 1803 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSAGADIAIDEVMITDEEEIRTTNPVATEQYGSVSTNLQAGNAQAATADVN

SEQ ID NO: 1804 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDEDRFFPQSGVLIFGKQSAGANNVEIESVMITDEEEIRTTNPVATEQYGSVSTNLQAGNAQAATADVN

SEQ ID NO: 1805 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTATGNNNSNFSWPGATTYHLNGRDSLVNPGPAMASHKDDEEKFFPQSGVLIFGKEGSRRDNAAIEHVMITDEEEIRTTNPVATEQYGSVSTNLQAGNAQAATADVN

SEQ ID NO: 1806 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWPGATKYHLNGRDSLVNPGPAMASHEDDKGKFFPQSGVLIFGKQGSEKTNVDIEKVMITDEEEIRTTNPVATEQYGSVSTNLQAGNAQAATADVN

SEQ ID NO: 1807 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGIKTLSRLGFSQAGASDIRDQSRNWLPGPCYRQQRVSKTSDGNNNSDFSWTGATKYHLNGRDSLVNPGPAMASHKDDDDRFFPQSGVLIFGKQGTGKSNVDVEEVMITDEEEIRTTNPVATEQYGSVSTNLQAGNAQAATADVN

SEQ ID NO: 1808 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTSADNNNSEYPWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1809 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTKTNSSLSFSQAGASDIRDQSRNWLPGPCYRQQRVSKQSDRNNNSEFSWTGATTYHLNGRDSLVNPGPAMASHKDDEDKFFPQSGVLIFGKESARKTDAAIDDVMITDEEEIRTTNPVATEQYGSVSTNLQAGNAQAATADVN

SEQ ID NO: 1810 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1811 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGTGTSNVDYGSVMITDEEEIRTTNPVATEQYGSVSTNLQAGNAQAATADVN

SEQ ID NO: 1812 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHGDDTGKFFPQSGVLIFGKQGSEKTNVDIEKVMITDEEEIRTTNPVATEQYGSVSTNLQKDRTPAAFQAVD

SEQ ID NO: 1813 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKTDGENNNSDFSWTGATKYHLNGRDSLVNPGPAMASHKDDEEKFFPQSGVLIFGKENGTASDVAFEEVMITDEEEIRTTNPVATEQYGSVSTNLQAGNAQAATADVN

SEQ ID NO: 1814 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQAAHNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1815 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRDAAAVQEVA

SEQ ID NO: 1816 - protein, 334 aa, Artificial Sequence
  Synthetic
TTGSTNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1817 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSITNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKEDSTTGDADIEGVMITDEEEIRTTNPVATEQYGSVSTNLQAGNAQAATADVN

SEQ ID NO: 1818 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 1819 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNKTMSALRFSQAGASDIRDQSRNWLPGPCYRQQRVSKQPSRNNNSEFSWTGATKYHLNGRDSLVNPGPAMASHKDDEEKFFPQSGVLIFGKESAAGTDVAFESVMITDEEEIRTTNPVATEQYGSVSTNLQAGNAQAATADVN

SEQ ID NO: 1820 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTHDRNNNSNFSWTGATKYHLNGRDSLVNPGPAMASHKDDDDRFFPQSGVLIFGKENSGKTDIEIESVMITDEEEIRTTNPVATEQYGSVSTNLQAGNAQAATADVN

SEQ ID NO: 1821 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1822 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQNGGKNDVDIEQVMITDEEEIRTTNPVATEQYGSVSTNLQAGNAQAATADVN

SEQ ID NO: 1823 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGASGTNIDVGRVMITDEEEIRTTNPVATEQYGSVSTNLQAGNAQAATADVN

SEQ ID NO: 1824 - protein, 334 aa, Artificial Sequence
  Synthetic
DSVASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEAGTITKSHLQFSQAGASDIRDQSRNWLPGPCYRQQRVSKQPSHNNNSDFSWTGATKYHLNGRDSLVNPGPAMASHKDDEGKFFPQSGVLIFGKQSAEGGNVDIDGVMITDEEEIRTTNPVATEQYGSVSTNLQAGNAQAATADVN

SEQ ID NO: 1825 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKKPDQNNNSEFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 1826 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 1827 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSKTYNDNNNSEYSWTGATKYHLNGRDSLVNPGPAMASHKDDEEKFFPQSGVLIFGKQNATKNDVAFGEVMITDEEEIRTTNPVATEQYGSVSTNLQAGNAQAATADVN

SEQ ID NO: 1828 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKEGSRRDNAAIEHVMITDEEEIRTTNPVATEQYGSVSTNLQAGNAQAATADVN

SEQ ID NO: 1829 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGRTTMSGLRFSQAGASDIRDQSRNWLPGPCYRQQRVSKQDTDNNNSDFSWTGATKYHLNGRDSLVNPGPAMASHGDDTGKFFPQSGVLIFGKQGSEKTNVDIEKVMITDEEEIRTTNPVATEQYGSVSTNLQAGNAQAATADVN

SEQ ID NO: 1830 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAGNNNSEFSWTGATKYHLNGRDSLVNPGPAMASHKDDEGKFFPQSGVLIFGKQNADRNNVEIGEVMITDEEEIRTTNPVATEQYGSVSTNLQAGNAQAATADVN

SEQ ID NO: 1831 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDGQNNNSNFSWTGATKYHLNGRDSLVNPGPAMASHRDDEEKFFPQSGVLIFGKQDSGATDIEIDRVMITDEEEIRTTNPVATEQYGSVSTNLQAGNAQAATADVN

SEQ ID NO: 1832 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNITKSELRFSQAGASDIRDQSRNWLPGPCYRQQRVSKTDGENNNSDFSWTGATKYHLNGRDSLVNPGPAMASHKDDEEKFFPQSGVLIFGKESTDGGNVAIDSVMITDEEEIRTTNPVATEQYGSVSTNLQAGNAQAATADVN

SEQ ID NO: 1833 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 1834 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTQRSPAASADVT

SEQ ID NO: 1835 - protein, 334 aa, Artificial Sequence; identical to SEQ ID NO: 335
  Synthetic

SEQ ID NO: 1836 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKEGAGKDNVDYGRVMITDEEEIRTTNPVATEQYGSVSTNLQAGNAQAATADVN

SEQ ID NO: 1837 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQGRSAGAAAGDVA

SEQ ID NO: 1838 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGPTTLSRLGFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 1839 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAGGTDVEIDSVMITDEEEIRTTNPVATEQYGSVSTNLQAGNAQAATADVN

SEQ ID NO: 1840 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKVSADNNNSEFSWTGATKYHLNGRDSLVNPGPAMASHKDDEEKFFPQSGVLIFGKESARGSNVEFDGVMITDEEEIRTTNPVATEQYGSVSTNLQAGNAQAATADVN

SEQ ID NO: 1841 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRSGRAATEGVT

SEQ ID NO: 1842 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGSLTQSRLRFSQAGASDIRDQSRNWLPGPCYRQQRVSTTANENNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1843 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQATKTNAATRDVN

SEQ ID NO: 1844 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQGSEKTNVDIEKVMITDEEEIRTTNPVATEQYGSVSTNLQRGNRQAATADVN

SEQ ID NO: 1845 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNRGGPVTNSALQFSQAGASDIRDQSRNWLPGPCYRQQRVSKTYNDNNNSEFSWTGATTYHLNGRDSLVNPGPAMASHKDDDERFFPQSGVLIFGKQGARRGNVAIDEVMITDEEEIRTTNPVATEQYGSVSTNLQAGNAQAATADVN

SEQ ID NO: 1846 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKKYTDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1847 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGTVTTSHLRFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1848 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNKTMSALRFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1849 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGHKTPSNLGFSQAGASDIRDQSRNWLPGPCYRQQRVSTQSTHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1850 - protein, 334 aa, Artificial Sequence
  Synthetic
STGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDQNNNSEFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 1851 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKESTDRGNADIGEVMITDEEEIRTTNPVATEQYGSVSTNLQAGNAQAATADVN

SEQ ID NO: 1852 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATKYHLNGRDSLVNPGPAMASHKDDEDKFFPQSGVLIFGKEDGGRGNVDVEDVMITDEEEIRTTNPVATEQYGSVSTNLQRGNRQAATADVN

SEQ ID NO: 1853 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENTTGNNVDIDRVMITDEEEIRTTNPVATEQYGSVSTNLQAGNAQAATADVN

SEQ ID NO: 1854 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGSRASAAATDVK

SEQ ID NO: 1855 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSTKPSDNNNSDFSWTGATTYHLNGRDSLVNPGPAMASHGDDADKFFPQSGVLIFGKQGSEKTNVDIEKVMITDEEEIRTTNPVATEQYGSVSTNLQAGNAQAATADVN

SEQ ID NO: 1856 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGIKTLSRLGFSQAGASDIRDQSRNWLPGPCYRQQRVSKTSNGNNNSEFSWTGATKYHLNGRDSLVNPGPAMASHRDDNEKFFPQSGVLIFGKEGAGGNNVEIDDVMITDEEEIRTTNPVATEQYGSVSTNLQAGNAQAATADVN

SEQ ID NO: 1857 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNGGRETLSRLKFSQAGASDIRDQSRNWLPGPCYRQQRVSTQSTGNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1858 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPKAAAAVAGVT

SEQ ID NO: 1859 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKEGSGASDVAIEQVMITDEEEIRTTNPVATEQYGSVSTNLQRGNRQAATADVN

SEQ ID NO: 1860 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDAENNNSEFSWPGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1861 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGPTTQSKLQFSQAGASDIRDQSRNWLPGPCYRQQRVSKKYTDNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1862 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQERRTHAATTEVN

SEQ ID NO: 1863 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTHSRLRFSQAGASDIRDQSRNWLPGPCYRQQRVSKQANHNNNSEFSWTGATTYHLNGRDSLVNPGPAMASHKDDDEKFFPQSGVLIFGKENGEAGNVDIDQVMITDEEEIRTTNPVATEQYGSVSTNLQAGNAQAATADVN

SEQ ID NO: 1864 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKQSSDNNNSEFSWTGATKYHLNGRDSLVNPGPAMASHKDDEEKFFPQSGVLIFGKQDGAGGDVAIEQVMITDEEEIRTTNPVATEQYGSVSTNLQAGNAQAATADVN

SEQ ID NO: 1865 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESTTGADTDIGGVMITDEEEIRTTNPVATEQYGSVSTNLQAGNAQAATADVN

SEQ ID NO: 1866 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRAQAAFNEVH

SEQ ID NO: 1867 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTKAPAATGEVT

SEQ ID NO: 1868 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGRFFPQSGVLIFGKQSATKNNIAIEHVMITDEEEIRTTNPVATEQYGSVSTNLQAGNAQAATADVN

SEQ ID NO: 1869 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDEDKFFPQSGVLIFGKQSATTGDVDVDRVMITDEEEIRTTNPVATEQYGSVSTNLQAGNAQAATADVN

SEQ ID NO: 1870 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHRDDDGKFFPQSGVLIFGKQNAGKSNIAFGNVMITDEEEIRTTNPVATEQYGSVSTNLQAGNAQAATADVN

SEQ ID NO: 1871 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPHSQAAFQSVD

SEQ ID NO: 1872 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNEKFFPQSGVLIFGKQSAGENDVEIGHVMITDEEEIRTTNPVATEQYGSVSTNLQAGNAQAATADVN

SEQ ID NO: 1873 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSDRSTAASTGVN

SEQ ID NO: 1874 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDDKFFPQSGVLIFGKESGNKNNADIGSVMITDEEEIRTTNPVATEQYGSVSTNLQAGNAQAATADVN

SEQ ID NO: 1875 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESAGTGNVAYEHVMITDEEEIRTTNPVATEQYGSVSTNLQAGNAQAATADVN

SEQ ID NO: 1876 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATTYHLNGRDSLVNPGPAMASHKDDDDKFFPQSGVLIFGKEGTGGGDVAVEKVMITDEEEIRTTNPVATEQYGSVSTNLQAGNAQAATADVN

SEQ ID NO: 1877 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKQDAGKTNVDVGNVMITDEEEIRTTNPVATEQYGSVSTNLQAGNAQAATADVN

SEQ ID NO: 1878 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTQDSDNNNSNFSWTGATKYHLNGRDSLVNPGPAMASHEDDNGKFFPQSGVLIFGKENSKATDAEIEDVMITDEEEIRTTNPVATEQYGSVSTNLQAGNAQAATADVN

SEQ ID NO: 1879 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKPNDNNNSNFSWTGATKYHLNGRDSLVNPGPAMASHRDDEDKFFPQSGVLIFGKESAGTNDAEVGDVMITDEEEIRTTNPVATEQYGSVSTNLQAGNAQAATADVN

SEQ ID NO: 1880 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGITTPSRLRFSQAGASDIRDQSRNWLPGPCYRQQRVSKQSGQNNNSDFSWTGATKYHLNGRDSLVNPGPAMASHKDDEGKFFPQSGVLIFGKQDSGATDIEIDRVMITDEEEIRTTNPVATEQYGSVSTNLQAGNAQAATADVN

SEQ ID NO: 1881 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNATTSRLMFSQAGASDIRDQSRNWLPGPCYRQQRVSKQSADNNNSDFSWTGATKYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 1882 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNGGTVTKSPLRFSQAGASDIRDQSRNWLPGPCYRQQRVSKQSADNNNSDFSWTGATKYHLNGRDSLVNPGPAMASHRDDEDKFFPQSGVLIFGKQDTGKNNVAIERVMITDEEEIRTTNPVATEQYGSVSTNLQAGNAQAATADVN

SEQ ID NO: 1883 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQNGGTGNVAIDRVMITDEEEIRTTNPVATEQYGSVSTNLQAGNAQAATADVN

SEQ ID NO: 1884 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTSADNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1885 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNARDNAADDSVN

SEQ ID NO: 1886 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1887 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1888 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSSGSDVDFDNVMITDEEEIRTTNPVATEQYGSVSTNLQAGNAQAATADVN

SEQ ID NO: 1889 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLRFSQAGASDIRDQSRNWLPGPCYRQQRVSKQPNDNNNSEFSWTGATTYHLNGRDSLVNPGPAMASHKDDNEKFFPQSGVLIFGKQGAKGNDAAVEQVMITDEEEIRTTNPVATEQYGSVSTNLQRGNRQAATADVN

SEQ ID NO: 1890 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 1891 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSTGTDVAYEGVMITDEEEIRTTNPVATEQYGSVSTNLQAGNAQAATADVN

SEQ ID NO: 1892 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGHNAAADQEVQ

SEQ ID NO: 1893 - protein, 334 aa, Artificial Sequence
  Synthetic
QSGTSNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGSTATDVDIGRVMITDEEEIRTTNPVATEQYGSVSTNLQAGNAQAATADVN

SEQ ID NO: 1894 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGPKTLSRLHFSQAGASDIRDQSRNWLPGPCYRQQRVSKTSADNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1895 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGNITLSKLRFSQAGASDIRDQSRNWLPGPCYRQQRVSKTSADNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 1896 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGRTTMSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1897 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKENSAGNNIEIGNVMITDEEEIRTTNPVATEQYGSVSTNLQAGNAQAATADVN

SEQ ID NO: 1898 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQNTSASNVEFDRVMITDEEEIRTTNPVATEQYGSVSTNLQAGNAQAATADVN

SEQ ID NO: 1899 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 1900 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHRDDEDKFFPQSGVLIFGKQSAKAANAAIDEVMITDEEEIRTTNPVATEQYGSVSTNLQAGNAQAATADVN

SEQ ID NO: 1901 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTGNNNSNFSWTGATKYHLNGRDSLVNPGPAMASHRDDADKFFPQSGVLIFGKEDAKGGNVDIERVMITDEEEIRTTNPVATEQYGSVSTNLQAGNAQAATADVN

SEQ ID NO: 1902 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDTGKFFPQSGVLIFGKQSSGKSNIAIEDVMITDEEEIRTTNPVATEQYGSVSTNLQAGNAQAATADVN

SEQ ID NO: 1903 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPTHNNNSNFSWTGATKYHLNGRDSLVNPGPAMASHKDDDDRFFPQSGVLIFGKEDAAKSDVDYEDVMITDEEEIRTTNPVATEQYGSVSTNLQAGNAQAATADVN

SEQ ID NO: 1904 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGPLTKSTLQFSQAGASDIRDQSRNWLPGPCYRQQRVSKTADHNNNSDFSWTGATKYHLNGRDSLVNPGPAMASHKDDDEKFFPQSGVLIFGKESSTENNVDIGRVMITDEEEIRTTNPVATEQYGSVSTNLQAGNAQAATADVN

SEQ ID NO: 1905 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSDFSWTGATKYHLNGRDSLVNPGPAMASHKDDDDRFFPQSGVLIFGKEGAKRGDVAIEGVMITDEEEIRTTNPVATEQYGSVSTNLQAGNAQAATADVN

SEQ ID NO: 1906 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKQASDNNNSEFSWTGATKYHLNGRDSLVNPGPAMASHKDDEEKFFPQSGVLIFGKENTSEGNVDIERVMITDEEEIRTTNPVATEQYGSVSTNLQAGNAQAATADVN

SEQ ID NO: 1907 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 1908 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1909 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSGDNNNSDFSWTGATKYHLNGRDSLVNPGPAMASHKDDEDKFFPQSGVLIFGKQGARGADAEIESVMITDEEEIRTTNPVATEQYGSVSTNLQAGNAQAATADVN

SEQ ID NO: 1910 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDDERFFPQSGVLIFGKQSASKNNIAIEEVMITDEEEIRTTNPVATEQYGSVSTNLQAGNAQAATADVN

SEQ ID NO: 1911 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKESGSGSDVDFDHVMITDEEEIRTTNPVATEQYGSVSTNLQAGNAQAATADVN

SEQ ID NO: 1912 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDHRTQAAADGVT

SEQ ID NO: 1913 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKDSRNNNSDFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 1914 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEGGTKNDVAIDGVMITDEEEIRTTNPVATEQYGSVSTNLQAGNAQAATADVN

SEQ ID NO: 1915 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGTTTTSDLRFSQAGASDIRDQSRNWLPGPCYRQQRVSKTSADNNNSEYSWTGATKYHLNGRDSLVNPGPAMASHRDDEDKFFPQSGVLIFGKQGAEEGDVEIEKVMITDEEEIRTTNPVATEQYGSVSTNLQAGNAQAATADVN

SEQ ID NO: 1916 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNGGRETLSRLKFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 1917 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGKAHAADRSVN

SEQ ID NO: 1918 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGSSAGAAAQVVQ

SEQ ID NO: 1919 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDKDKFFPQSGVLIFGKQGSEKTNVDIEKVMITDEEEIRTTNPVATEQYGSVSTNLQAGNAQAATADVN

SEQ ID NO: 1920 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNKGGNLTNSTLEFSQAGASDIRDQSRNWLPGPCYRQQRVSKQPGDNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1921 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDAGRNDVAFDHVMITDEEEIRTTNPVATEQYGSVSTNLQAGNAQAATADVN

SEQ ID NO: 1922 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDNDRFFPQSGVLIFGKESAARTDADFDKVMITDEEEIRTTNPVATEQYGSVSTNLQAGNAQAATADVN

SEQ ID NO: 1923 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGRAGAAFQIVQ

SEQ ID NO: 1924 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQSANESNADIENVMITDEEEIRTTNPVATEQYGSVSTNLQAGNAQAATADVN

SEQ ID NO: 1925 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1926 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 1927 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQSSGKSNIAIEGVMITDEEEIRTTNPVATEQYGSVSTNLQAGNAQAATADVN

SEQ ID NO: 1928 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 1929 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGHKTTSNLGFSQAGASDIRDQSRNWLPGPCYRQQRVSKTHGDNNNSNFSWTGATTYHLNGRDSLVNPGPAMASHEDDNEKFFPQSGVLIFGKEGSEKTNVDIEKVMITDEEEIRTTNPVATEQYGSVSTNLQAGNAQAATADVN

SEQ ID NO: 1930 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 1931 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGNDGAAFTAVD

SEQ ID NO: 1932 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSITMSGLRFSQAGASDIRDQSRNWLPGPCYRQQRVSKTHGDNNNSNFSWTGATTYHLNGRDSLVNPGPAMASHKDDAEKFFPQSGVLIFGKQGANRDNADIDQVMITDEEEIRTTNPVATEQYGSVSTNLQAGNAQAATADVN

SEQ ID NO: 1933 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGPITPSPLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 1934 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAKGGPTTHSPLRFSQAGASDIRDQSRNWLPGPCYRQQRVSKTSADNNNSEYSWTGATKYHLNGRDSLVNPGPAMASHKDDDEKFFPQSGVLIFGKEGAGAADADVDHVMITDEEEIRTTNPVATEQYGSVSTNLQAGNAQAATADVN

SEQ ID NO: 1935 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGRFFPQSGVLIFGKQGAGEANVDVDGVMITDEEEIRTTNPVATEQYGSVSTNLQAGNAQAATADVN

SEQ ID NO: 1936 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDTGRFFPQSGVLIFGKQGSEKTNVDIEKVMITDEEEIRTTNPVATEQYGSVSTNLQAGNAQAATADVN

SEQ ID NO: 1937 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTQRGQAAADMVA

SEQ ID NO: 1938 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKEDSGRTNIDIDNVMITDEEEIRTTNPVATEQYGSVSTNLQAGNAQAATADVN

SEQ ID NO: 1939 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGRTQAAVKAVD

SEQ ID NO: 1940 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTMSKLRFSQAGASDIRDQSRNWLPGPCYRQQRVSTTPTGNNNSDFSWTGATKYHLNGRDSLVNPGPAMASHKDDDGRFFPQSGVLIFGKQGSEKTNVDIEKVMITDEEEIRTTNPVATEQYGSVSTNLQAGNAQAATADVN

SEQ ID NO: 1941 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGRETLSRLKFSQAGASDIRDQSRNWLPGPCYRQQRVSTQSTGNNNSDFSWTGATKYHLNGRDSLVNPGPAMASHKDDDDRFFPQSGVLIFGKQSGAGADVEIGEVMITDEEEIRTTNPVATEQYGSVSTNLQAGNAQAATADVN

SEQ ID NO: 1942 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGQTAAAVEGVH

SEQ ID NO: 1943 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKQNAGKDDVDIDQVMITDEEEIRTTNPVATEQYGSVSTNLQAGNAQAATADVN

SEQ ID NO: 1944 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTKATDNNNSNFSWTGATTYHLNGRDSLVNPGPAMASHRDDNDKFFPQSGVLIFGKQSARGTNADIDEVMITDEEEIRTTNPVATEQYGSVSTNLQAGNAQAATADVN

SEQ ID NO: 1945 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTSGLKTTSHLGFSQAGASDIRDQSRNWLPGPCYRQQRVSKQPTGNNNSNFSWTGATKYHLNGRDSLVNPGPAMASHEDDAGRFFPQSGVLIFGKQGSEKTNVDIEKVMITDEEEIRTTNPVATEQYGSVSTNLQDPRDEAAVEMVH

SEQ ID NO: 1946 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKTDGENNNSDFSWTGATKYHLNGRDSLVNPGPAMASHKDDEEKFFPQSGVLIFGKENAEKNDVAIDRVMITDEEEIRTTNPVATEQYGSVSTNLQAGNAQAATADVN

SEQ ID NO: 1947 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNTGAADGTVE

SEQ ID NO: 1948 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAGGNATLSSLRFSQAGASDIRDQSRNWLPGPCYRQQRVSKQSSDNNNSNFSWTGATKYHLNGRDSLVNPGPAMASHKDDDERFFPQSGVLIFGKESSDRNNVDIEQVMITDEEEIRTTNPVATEQYGSVSTNLQAGNAQAATADVN

SEQ ID NO: 1949 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDTKAQAANSDVE

SEQ ID NO: 1950 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKENTATDDVDIGHVMITDEEEIRTTNPVATEQYGSVSTNLQAGNAQAATADVN

SEQ ID NO: 1951 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAAGNMTMSALLFSQAGASDIRDQSRNWLPGPCYRQQRVSKKASDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1952 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENSGTNNAEIDNVMITDEEEIRTTNPVATEQYGSVSTNLQAGNAQAATADVN

SEQ ID NO: 1953 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDEKFFPQSGVLIFGKEDGKGANVDIGEVMITDEEEIRTTNPVATEQYGSVSTNLQAGNAQAATADVN

SEQ ID NO: 1954 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 1955 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGRATNSELRFSQAGASDIRDQSRNWLPGPCYRQQRVSKTDGENNNSDFSWTGATKYHLNGRDSLVNPGPAMASHKDDEGRFFPQSGVLIFGKEGTRKNNVDIEEVMITDEEEIRTTNPVATEQYGSVSTNLQAGNAQAATADVN

SEQ ID NO: 1956 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGKRDPAANSEVN

SEQ ID NO: 1957 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDERFFPQSGVLIFGKEDTGKANVDIGNVMITDEEEIRTTNPVATEQYGSVSTNLQAGNAQAATADVN

SEQ ID NO: 1958 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQDGTGGDVAIERVMITDEEEIRTTNPVATEQYGSVSTNLQAGNAQAATADVN

SEQ ID NO: 1959 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTKHGGNNNSNFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 1960 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKEGSGTGNVEIDSVMITDEEEIRTTNPVATEQYGSVSTNLQAGNAQAATADVN

SEQ ID NO: 1961 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRNGATDNSVE

SEQ ID NO: 1962 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHVTQSWLLFSQAGASDIRDQSRNWLPGPCYRQQRVSKQPAGNNNSEFSWTGATKYHLNGRDSLVNPGPAMASHGDDKDKFFPQSGVLIFGKQNATGNDVEIEHVMITDEEEIRTTNPVATEQYGSVSTNLQAGNAQAATADVN

SEQ ID NO: 1963 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSADNNNSNFSWTGATKYHLNGRDSLVNPGPAMASHRDDEDKFFPQSGVLIFGKEGTGGNDAEIDDVMITDEEEIRTTNPVATEQYGSVSTNLQAGNAQAATADVN

SEQ ID NO: 1964 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNITKSELRFSQAGASDIRDQSRNWLPGPCYRQQRVSKQASDNNNSNFSWTGATTYHLNGRDSLVNPGPAMASHKDDEGRFFPQSGVLIFGKQSAKAANAAIDEVMITDEEEIRTTNPVATEQYGSVSTNLQAGNAQAATADVN

SEQ ID NO: 1965 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDDDRFFPQSGVLIFGKQNGGGNNVDVDQVMITDEEEIRTTNPVATEQYGSVSTNLQAGNAQAATADVN

SEQ ID NO: 1966 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQERRSPAATGEVD

SEQ ID NO: 1967 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQANKNGAASSVVA

SEQ ID NO: 1968 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTTDTDNNNSDFSWTGATTYHLNGRDSLVNPGPAMASHRDDTGRFFPQSGVLIFGKQGSEKTNVDIEKVMITDEEEIRTTNPVATEQYGSVSTNLQRGNRQAATADVN

SEQ ID NO: 1969 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGANTNNTAIDSVMITDEEEIRTTNPVATEQYGSVSTNLQAGNAQAATADVN

SEQ ID NO: 1970 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDGGRATQSRLVFSQAGASDIRDQSRNWLPGPCYRQQRVSKTDGENNNSDFSWTGATTYHLNGRDSLVNPGPAMASHGDDADKFFPQSGVLIFGKEGAGAANVEIDRVMITDEEEIRTTNPVATEQYGSVSTNLQAGNAQAATADVN

SEQ ID NO: 1971 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDEEKFFPQSGVLIFGKQGTGRDNVDFERVMITDEEEIRTTNPVATEQYGSVSTNLQAGNAQAATADVN

SEQ ID NO: 1972 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGNMTKSTLEFSQAGASDIRDQSRNWLPGPCYRQQRVSKQSDHNNNSNFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 1973 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDKFFPQSGVLIFGKQGTEGTNVAIEEVMITDEEEIRTTNPVATEQYGSVSTNLQAGNAQAATADVN

SEQ ID NO: 1974 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKSGTMTKSPLMFSQAGASDIRDQSRNWLPGPCYRQQRVSKKPSENNNSDFSWTGATTYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 1975 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNERFFPQSGVLIFGKEGAGANDVAYENVMITDEEEIRTTNPVATEQYGSVSTNLQAGNAQAATADVN

SEQ ID NO: 1976 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATKYHLNGRDSLVNPGPAMASHRDDDEKFFPQSGVLIFGKQGTKKTNAEIEDVMITDEEEIRTTNPVATEQYGSVSTNLQAGNAQAATADVN

SEQ ID NO: 1977 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDTGKFFPQSGVLIFGKQGSEKTNVDIEKVMITDEEEIRTTNPVATEQYGSVSTNLQAGNAQAATADVN

SEQ ID NO: 1978 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHKDDEDKFFPQSGVLIFGKQGSGEANVDYDRVMITDEEEIRTTNPVATEQYGSVSTNLQAGNAQAATADVN

SEQ ID NO: 1979 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPSGSTTMSTLRFSQAGASDIRDQSRNWLPGPCYRQQRVSKTSADNNNSNFSWTGATKYHLNGRDSLVNPGPAMASHKDDEDKFFPQSGVLIFGKESAGKTNTEYDKVMITDEEEIRTTNPVATEQYGSVSTNLQAGNAQAATADVN

SEQ ID NO: 1980 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRDPAANEGVN

SEQ ID NO: 1981 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNATTSRLMFSQAGASDIRDQSRNWLPGPCYRQQRVSTTPTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 1982 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGITTQSRLQFSQAGASDIRDQSRNWLPGPCYRQQRVSKTSADNNNSNFSWTGATKYHLNGRDSLVNPGPAMASHRDDEDKFFPQSGVLIFGKEGAAADNIDIGQVMITDEEEIRTTNPVATEQYGSVSTNLQAGNAQAATADVN

SEQ ID NO: 1983 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1984 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKEGTDKANVDIDGVMITDEEEIRTTNPVATEQYGSVSTNLQAGNAQAATADVN

SEQ ID NO: 1985 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKENGRGDNVAYEDVMITDEEEIRTTNPVATEQYGSVSTNLQAGNAQAATADVN

SEQ ID NO: 1986 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGRDQAAARIVN

SEQ ID NO: 1987 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 1988 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1989 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDRFFPQSGVLIFGKEDAGKTNIDIGQVMITDEEEIRTTNPVATEQYGSVSTNLQAGNAQAATADVN

SEQ ID NO: 1990 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1991 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAKGGPTTHSPLRFSQAGASDIRDQSRNWLPGPCYRQQRVSTTPGGNNNSNFSWTGATKYHLNGRDSLVNPGPAMASHKDDDDKFFPQSGVLIFGKQGSTGSNIEFDGVMITDEEEIRTTNPVATEQYGSVSTNLQAGNAQAATADVN

SEQ ID NO: 1992 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPTGNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1993 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 1994 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 1995 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATTYHLNGRDSLVNPGPAMASHKDDNEKFFPQSGVLIFGKEGANRNNVEFEDVMITDEEEIRTTNPVATEQYGSVSTNLQAGNAQAATADVN

SEQ ID NO: 1996 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENGDKTNVEIDRVMITDEEEIRTTNPVATEQYGSVSTNLQAGNAQAATADVN

SEQ ID NO: 1997 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRARSPAATRDVE

SEQ ID NO: 1998 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSGRNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 1999 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSNQNNNSEFSWPGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 2000 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGAGKNNAAIGQVMITDEEEIRTTNPVATEQYGSVSTNLQAGNAQAATADVN

SEQ ID NO: 2001 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQGAGKNNAAIGQVMITDEEEIRTTNPVATEQYGSVSTNLQAGNAQAATADVN

SEQ ID NO: 2002 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDAEKFFPQSGVLIFGKQGSEKTNVDIEKVMITDEEEIRTTNPVATEQYGSVSTNLQAGNAQAATADVN

SEQ ID NO: 2003 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGRPTISRLLFSQAGASDIRDQSRNWLPGPCYRQQRVSKTDGENNNSDFSWTGATKYHLNGRDSLVNPGPAMASHRDDEEKFFPQSGVLIFGKQSGAGTDVDFENVMITDEEEIRTTNPVATEQYGSVSTNLQAGNAQAATADVN

SEQ ID NO: 2004 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGPETHSQLVFSQAGASDIRDQSRNWLPGPCYRQQRVSKKSTGNNNSDFSWTGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 2005 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGAKGTNVEFGKVMITDEEEIRTTNPVATEQYGSVSTNLQAGNAQAATADVN

SEQ ID NO: 2006 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGRFFPQSGVLIFGKQGAGKSDVEVGKVMITDEEEIRTTNPVATEQYGSVSTNLQAGNAQAATADVN

SEQ ID NO: 2007 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATKYHLNGRDSLVNPGPAMASHRDDEDKFFPQSGVLIFGKEDSGGNDVEVEDVMITDEEEIRTTNPVATEQYGSVSTNLQAGNAQAATADVN

SEQ ID NO: 2008 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSAASNADVGQVMITDEEEIRTTNPVATEQYGSVSTNLQAGNAQAATADVN

SEQ ID NO: 2009 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEGGAGADVDIGQVMITDEEEIRTTNPVATEQYGSVSTNLQAGNAQAATADVN

SEQ ID NO: 2010 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWPGATTYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 2011 - protein, 334 aa, Artificial Sequence; identical to SEQ ID NO: 324
  Synthetic

SEQ ID NO: 2012 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKQDTDNNNSDFSWTGATKYHLNGRDSLVNPGPAMASHKDDDDRFFPQSGVLIFGKQGSGKSNVAFGDVMITDEEEIRTTNPVATEQYGSVSTNLQAGNAQAATADVN

SEQ ID NO: 2013 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNAGGINTNSRLLFSQAGASDIRDQSRNWLPGPCYRQQRVSKTHGDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2014 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2015 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGSLTKSQLGFSQAGASDIRDQSRNWLPGPCYRQQRVSKTSADNNNSEYSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 2016 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGHMTLSGLRFSQAGASDIRDQSRNWLPGPCYRQQRVSKTSADNNNSNFSWTGATKYHLNGRDSLVNPGPAMASHKDDDEKFFPQSGVLIFGKQDASKNNVDVDGVMITDEEEIRTTNPVATEQYGSVSTNLQAGNAQAATADIN

SEQ ID NO: 2017 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQGATKDDVDFDGVMITDEEEIRTTNPVATEQYGSVSTNLQAGNAQAATADVN

SEQ ID NO: 2018 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGRGGTQTTSGLRFSQAGASDIRDQSRNWLPGPCYRQQRVSKRPTDNNNSEFSWPGATTYHLNGRDSLVNPGPAMASHKDDNDKFFPQSGVLIFGKQNAGATDVDIGSVMITDEEEIRTTNPVATEQYGSVSTNLQAGNAQAATADVN

SEQ ID NO: 2019 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKENSAADDVAIGDVMITDEEEIRTTNPVATEQYGSVSTNLQAGNAQAATADVN

SEQ ID NO: 2020 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2021 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRTGIQTQSRLGFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2022 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGTGKGNTDIEQVMITDEEEIRTTNPVATEQYGSVSTNLQAGNAQAATADVN

SEQ ID NO: 2023 - protein, 334 aa, Artificial Sequence; identical to SEQ ID NO: 379
  Synthetic

SEQ ID NO: 2024 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTTSTLQFSQAGASDIRDQSRNWLPGPCYRQQRVSKTAGRNNNSDFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 2025 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGRETISRLQFSQAGASDIRDQSRNWLPGPCYRQQRVSKTDGENNNSDFSWTGATKYHLNGRDSLVNPGPAMASHKDDEEKFFPQSGVLIFGKQGSARDNIAIEGVMITDEEEIRTTNPVATEQYGSVSTNLQAGNAQAATADVN

SEQ ID NO: 2026 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKEGAAANNVEIDGVMITDEEEIRTTNPVATEQYGSVSTNLQAGNAQAATADVN

SEQ ID NO: 2027 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADRFFPQSGVLIFGKENSDKTNADIGDVMITDEEEIRTTNPVATEQYGSVSTNLQAGNAQAATADVN

SEQ ID NO: 2028 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSSSGSVTPSDLHFSQAGASDIRDQSRNWLPGPCYRQQRVSKTSADNNNSDFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 2029 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWPGATTYHLNGRDSLVNPGPAMASHRDDEDKFFPQSGVLIFGKQDSKKGNVEIGQVMITDEEEIRTTNPVATEQYGSVSTNLQAGNAQAATADVN

SEQ ID NO: 2030 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGARGANAEIESVMITDEEEIRTTNPVATEQYGSVSTNLQAGNAQAATADVN

SEQ ID NO: 2031 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKENAGASDIAIDHVMITDEEEIRTTNPVATEQYGSVSTNLQAGNAQAATADVN

SEQ ID NO: 2032 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 2033 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKEDAGKADVEIGKVMITDEEEIRTTNPVATEQYGSVSTNLQAGNAQAATADVN

SEQ ID NO: 2034 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 2035 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKQGATRSNIDIGNVMITDEEEIRTTNPVATEQYGSVSTNLQAGNAQAATADVN

SEQ ID NO: 2036 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGPATKSGLRFSQAGASDIRDQSRNWLPGPCYRQQRVSKTYNDNNNSEFSWTGATTYHLNGRDSLVNPGPAMASHKDDEEKFFPQSGVLIFGKEGGNGSNVDIGRVMITDEEEIRTTNPVATEQYGSVSTNLQAGNAQAATADVN

SEQ ID NO: 2037 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALLFSQAGASDIRDQSRNWLPGPCYRQQRVSKTDGENNNSDFSWTGATKYHLNGRDSLVNPGPAMASHKDDEEKFFPQSGVLIFGKQGAAETDVDIENVMITDEEEIRTTNPVATEQYGSVSTNLQAGNAQAATADVN

SEQ ID NO: 2038 - protein, 334 aa, Artificial Sequence
  Synthetic
HTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSADNNNSNFSWTGATKYHLNGRDSLVNPGPAMASHRDDEDKFFPQSGVLIFGKEGTGGNDAEIDDVMITDEEEIRTTNPVATEQYGSVSTNLQAGNAQAATADVN

SEQ ID NO: 2039 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPRTAAANRDVP

SEQ ID NO: 2040 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRDRAAAAIREVH

SEQ ID NO: 2041 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2042 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWPGATTYHLNGRDSLVNPGPAMASHKDDEEKFFPQSGVLIFGKESAGRSNVDVDRVMITDEEEIRTTNPVATEQYGSVSTNLQAGNAQAATADVN

SEQ ID NO: 2043 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKAGSATTSALGFSQAGASDIRDQSRNWLPGPCYRQQRVSKVSADNNNSEFSWTGATKYHLNGRDSLVNPGPAMASHKDDEEKFFPQSGVLIFGKEGAAANNVEIDGVMITDEEEIRTTNPVATEQYGSVSTNLQAGNAQAATADVN

SEQ ID NO: 2044 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGTKTMSRLEFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 2045 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNAQAATADVN

SEQ ID NO: 2046 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2047 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGHTTQSRLLFSQAGASDIRDQSRNWLPGPCYRQQRVSKTSADNNNSNFSWTGATKYHLNGRDSLVNPGPAMASHRDDEEKFFPQSGVLIFGKQGSEKTNVDIEKVMITDEEEIRTTNPVATEQYGSVSTNLQAGNAQAATADVN

SEQ ID NO: 2048 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHRDDDDKFFPQSGVLIFGKEGTSKDNVAYEDVMITDEEEIRTTNPVATEQYGSVSTNLQAGNAQAATADVN

SEQ ID NO: 2049 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2050 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAKDRAANNAVH

SEQ ID NO: 2051 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSTQPSQNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2052 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNGRDGAANRTVP

SEQ ID NO: 2053 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNVTISQLGFSQAGASDIRDQSRNWLPGPCYRQQRVSTQSTQNNNSEFSWTGATKYHLNGRDSLVNPGPAMASHRDDAEKFFPQSGVLIFGKESAKKTDAAIDDVMITDEEEIRTTNPVATEQYGSVSTNLQAGNAQAATADVN

SEQ ID NO: 2054 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAKSGNVTMSGLRFSQAGASDIRDQSRNWLPGPCYRQQRVSTQSTQNNNSEFSWTGATKYHLNGRDSLVNPGPAMASHRDDEDKFFPQSGVLIFGKQSGGATDVEIENVMITDEEEIRTTNPVATEQYGSVSTNLQAGNAQAATADVN

SEQ ID NO: 2055 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQNGGRANIDIEHVMITDEEEIRTTNPVATEQYGSVSTNLQAGNAQAATADVN

SEQ ID NO: 2056 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGNPTMSELRFSQAGASDIRDQSRNWLPGPCYRQQRVSTQYTDNNNSNFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2057 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQKTRNTAAAGDVH

SEQ ID NO: 2058 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2059 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQRSHAADRNVE

SEQ ID NO: 2060 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKKASDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 2061 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGGTKDDVDIDNVMITDEEEIRTTNPVATEQYGSVSTNLQAGNAQAATADVN

SEQ ID NO: 2062 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTTGHNTLSGLRFSQAGASDIRDQSRNWLPGPCYRQQRVSTTPGGNNNSNFSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 2063 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAERGNADIGHVMITDEEEIRTTNPVATEQYGSVSTNLQAGNAQAATADVN

SEQ ID NO: 2064 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGAGATNTDIGRVMITDEEEIRTTNPVATEQYGSVSTNLQAGNAQAATADVN

SEQ ID NO: 2065 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 2066 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGPITKSQLKFSQAGASDIRDQSRNWLPGPCYRQQRVSTQASGNNNSDFSWTGATKYHLNGRDSLVNPGPAMASHKDDDEKFFPQSGVLIFGKEDTGADNVDIDSVMITDEEEIRTTNPVATEQYGSVSTNLQAGNAQAATADVN

SEQ ID NO: 2067 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKRPTDNNNSEFSWTGATKYHLNGRDSLVNPGPAMASHKDDDDRFFPQSGVLIFGKEGAGETNVEIENVMITDEEEIRTTNPVATEQYGSVSTNLQAGNAQAATADVN

SEQ ID NO: 2068 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQYTDNNNSNFSWTGATTYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 2069 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRNSPAAFTEVP

SEQ ID NO: 2070 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKEDGGGSNVEIGRVMITDEEEIRTTNPVATEQYGSVSTNLQAGNAQAATADVN

SEQ ID NO: 2071 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGKFFPQSGVLIFGKEGAGGSNVAVDGVMITDEEEIRTTNPVATEQYGSVSTNLQAGNAQAATADVN

SEQ ID NO: 2072 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNKTLSRLKFSQAGASDIRDQSRNWLPGPCYRQQRVSKVSADNNNSEFSWTGSTKYHLNGRDSLVNPGPAMASHKDDEEKFFPQSGVLIFGKQGTGASNVEVENVMITDEEEIRTTNPVATEQYGSVSTNLQAGNAQAATADVN

SEQ ID NO: 2073 - protein, 334 aa, Artificial Sequence; identical to SEQ ID NO: 218
  Synthetic

SEQ ID NO: 2074 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDRFFPQSGVLIFGKQGSEKTNVDIEKVMITDEEEIRTTNPVATEQYGSVSTNLQAGNAQAATADVN

SEQ ID NO: 2075 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 2076 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAATGNTTPSPLRFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 2077 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKEDTGGNDIAIDDVMITDEEEIRTTNPVATEQYGSVSTNLQAGNAQAATADVN

SEQ ID NO: 2078 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGRTTMSGLRFSQAGASDIRDQSRNWLPGPCYRQQRVSKQSDRNNNSEFSWTGATKYHLNGRDSLVNPGPAMASHKDDEDKFFPQSGVLIFGKQGGRGSDVAIGDVMITDEEEIRTTNPVATEQYGSVSTNLQAGNAQAATADVN

SEQ ID NO: 2079 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRNTQAANNGVQ

SEQ ID NO: 2080 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKEDAAKTNAAVDQVMITDEEEIRTTNPVATEQYGSVSTNLQAGNAQAATADVN

SEQ ID NO: 2081 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARHSGAAFNIVE

SEQ ID NO: 2082 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKESGKASNVAIGEVMITDEEEIRTTNPVATEQYGSVSTNLQAGNAQAATADVN

SEQ ID NO: 2083 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVNIEKVMITDEEEIRTTNPVATEQYGSVSTNLQAGNAQAATADVN

SEQ ID NO: 2084 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGSEKTNVDIEKVMITDEEEIRTTNPVATEQYGSVSTNLQAGNAQAATADVN

SEQ ID NO: 2085 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKEDTAKGNVEIGKVMITDEEEIRTTNPVATEQYGSVSTNLQAGNAQAATADVN

SEQ ID NO: 2086 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSNFSWTGATKYHLNGRDSLVNPGPAMASHKDDDDKFFPQSGVLIFGKQDARAADADIEQVMITDEEEIRTTNPVATEQYGSVSTNLQAGNAQAATADVN

SEQ ID NO: 2087 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNQTNSRLVFSQAGASDIRDQSRNWLPGPCYRQQRVSKVSADNNNSEFSWTGATKYHLNGRDSLVNPGPAMASHKDDEEKFFPQSGVLIFGKQGTGASNADIDHVMITDEEEIRTTNPVATEQYGSVSTNLQAGNAQAATADVN

SEQ ID NO: 2088 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 2089 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKAGLQTPSNLLFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2090 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGLVTMSGLRFSQAGASDIRDQSRNWLPGPCYRQQRVSTQPNRNNNSEFSWPGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 2091 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQDAGESNVAFEQVMITDEEEIRTTNPVATEQYGSVSTNLQAGNAQAATADVN

SEQ ID NO: 2092 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAQRAQAATQGVE

SEQ ID NO: 2093 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAQRATAASNGVN

SEQ ID NO: 2094 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 2095 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDDGKFFPQSGVLIFGKQDASGSNTAYESVMITDEEEIRTTNPVATEQYGSVSTNLQAGNAQAATADVN

SEQ ID NO: 2096 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAETGTATTSRLKFSQAGASDIRDQSRNWLPGPCYRQQRVSKQYDHNNNSNFSWPGATTYHLNGRDSLVNPGPAMASHRDDEEKFFPQSGVLIFGKQGSEKTNVDIEKVMITDEEEIRTTNPVATEQYGSVSTNLQAGNAQAATADVN

SEQ ID NO: 2097 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSTQASGNNNSEFSWTGATKYHLNGRDSLVNPGPAMASHRDDEDKFFPQSGVLIFGKEGATATNVEIDDVMITDEEEIRTTNPVATEQYGSVSTNLQAGNAQAATADVN

SEQ ID NO: 2098 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQNASENNVDFDRVMITDEEEIRTTNPVATEQYGSVSTNLQAGNAQAATADVN

SEQ ID NO: 2099 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNTGSKTLSRLKFSQAGASDIRDQSRNWLPGPCYRQQRVSKQSGDNNNSEFSWTGATKYHLNGRDSLVNPGPAMASHRDDEDKFFPQSGVLIFGKEGGSANDVEFDGVMITDEEEIRTTNPVATEQYGSVSTNLQAGNAQAATADVN

SEQ ID NO: 2100 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGSVTMSTLLFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQRGNRQAATADVN

SEQ ID NO: 2101 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKENAGASDIAIDHVMITDEEEIRTTNPVATEQYGSVSTNLQAGNAQAATADVN

SEQ ID NO: 2102 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKEGGTANNVAVDKVMITDEEEIRTTNPVATEQYGSVSTNLQAGNAQAATADVN

SEQ ID NO: 2103 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKQNGGKNDVDIEQVMITDEEEIRTTNPVATEQYGSVSTNLQAGNAQAATADVN

SEQ ID NO: 2104 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRNGAAFGGVT

SEQ ID NO: 2105 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2106 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDDRFFPQSGVLIFGKEGGGAANVEVDSVMITDEEEIRTTNPVATEQYGSVSTNLQAGNAQAATADVN

SEQ ID NO: 2107 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTGNNNSNFSWTGATKYHLNGRDSLVNPGPAMASHRDDADKFFPQSGVLIFGKEDAKGGNVDIERVMITDEEEIRTTNPVATEQYGSVSTNLQAGNAQAATADVN

SEQ ID NO: 2108 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGIATKSQLRFSQAGASDIRDQSRNWLPGPCYRQQRVSKTPAENNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2109 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGASETNVEIDKVMITDEEEIRTTNPVATEQYGSVSTNLQAGNAQAATADVN

SEQ ID NO: 2110 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2111 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNRRATAASTDVT

SEQ ID NO: 2112 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRSQAAYSMVT

SEQ ID NO: 2113 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKEGSGANDVAIEKVMITDEEEIRTTNPVATEQYGSVSTNLQAGNAQAATADVN

SEQ ID NO: 2114 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKKPSENNNSDFSWTGATTYHLNGRDSLVNPGPAMASHKDDEEKFFPQSGVLIFGKEGTDKANVDIDGVMITDEEEIRTTNPVATEQYGSVSTNLQAGNAQAATADVN

SEQ ID NO: 2115 - protein, 334 aa, Artificial Sequence
  Synthetic
KAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNKTMSRLQFSQAGASDIRDQSRNWLPGPCYRQQRVSKQPSENNNSDFSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 2116 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGAEGDNVDVDHVMITDEEEIRTTNPVATEQYGSVSTNLQAGNAQAATADVN

SEQ ID NO: 2117 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQDATATNADYEHVMITDEEEIRTTNPVATEQYGSVSTNLQAGNAQAATADVN

SEQ ID NO: 2118 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGNPTPSDLRFSQAGASDIRDQSRNWLPGPCYRQQRVSKQASDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2119 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQTGLATISKLKFSQAGASDIRDQSRNWLPGPCYRQQRVSTQSAHNNNSNFSWTGATKYHLNGRDSLVNPGPAMASHRDDDDKFFPQSGVLIFGKESGRKGDADFEEVMITDEEEIRTTNPVATEQYGSVSTNLQAGNAQAATADVN

SEQ ID NO: 2120 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDTQNNNSEFSWTGATKYHLNGRDSLVNPGPAMASHKDDDDRFFPQSGVLIFGKQGATRDNTDIGHVMITDEEEIRTTNPVATEQYGSVSTNLQAGNAQAATADVN

SEQ ID NO: 2121 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENSTRTDAAIDEVMITDEEEIRTTNPVATEQYGSVSTNLQAGNAQAATADVN

SEQ ID NO: 2122 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGSEKTNVDIEKVMITDEEEIRTTNPVATEQYGSVSTNLQRGNRQAATADVN

SEQ ID NO: 2123 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNENNNSDFSWTGATKYHLNGRDSLVNPGPAMASHGDDNDKFFPQSGVLIFGKQNGAESDIEIDGVMITDEEEIRTTNPVATEQYGSVSTNLQAGNAQAATADVN

SEQ ID NO: 2124 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKAGSETNSRLLFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2125 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRGRAADSEVH

SEQ ID NO: 2126 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYCLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2127 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSSTGHITISTLGFSQAGASDIRDQSRNWLPGPCYRQQRVSKQSSDNNNSEFSWTGATKYHLNGRDSLVNPGPAMASHEDDNDKFFPQSGVLIFGKQGAAETDVDIENVMITDEEEIRTTNPVATEQYGSVSTNLQAGNAQAATADVN

SEQ ID NO: 2128 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQNGSANNVAFGQVMITDEEEIRTTNPVATEQYGSVSTNLQAGNAQAATADVN

SEQ ID NO: 2129 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGGRAADAAFEEVMITDEEEIRTTNPVATEQYGSVSTNLQAGNAQAATADVN

SEQ ID NO: 2130 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSKQDTDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2131 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQSSEKTNVDIEKVMITDEEEIRTTNPVATEQYGSVSTNLQAGNAQAATADVN

SEQ ID NO: 2132 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTERTGAAFDEVD

SEQ ID NO: 2133 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSTAAGNVDVDGVMITDEEEIRTTNPVATEQYGSVSTNLQAGNAQAATADVN

SEQ ID NO: 2134 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAPRGNAAVTNVT

SEQ ID NO: 2135 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDDEKFFPQSGVLIFGKENGKNTNTDVGGVMITDEEEIRTTNPVATEQYGSVSTNLQAGNAQAATADVN

SEQ ID NO: 2136 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDKFFPQSGVLIFGKQGASETNVEIDKVMITDEEEIRTTNPVATEQYGSVSTNLQAGNAQAATADVN

SEQ ID NO: 2137 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGTTGANVAYEDVMITDEEEIRTTNPVATEQYGSVSTNLQRGNRQAATADVN

SEQ ID NO: 2138 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2139 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQSGLNTLSDLRFSQAGASDIRDQSRNWLPGPCYRQQRVSKRPTDNNNSEFSWPGATTYHLNGRDSLVNPGPAMASHKDDNDKFFPQSGVLIFGKEGAGKTDVAIGRVMITDEEEIRTTNPVATEQYGSVSTNLQAGNAQAATADVN

SEQ ID NO: 2140 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGPATLSTLKFSQAGASDIRDQSRNWLPGPCYRQQRVSTQSTGNNNSDFSWTGATKYHLNGRDSLVNPGPAMASHRDDDDKFFPQSGVLIFGKQGAAETDVDIENVMITDEEEIRTTNPVATEQYGSVSTNLQAGNAQAATADVN

SEQ ID NO: 2141 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEAKARAAFQDVH

SEQ ID NO: 2142 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEDGKGNNVAFEKVMITDEEEIRTTNPVATEQYGSVSTNLQAGNAQAATADVN

SEQ ID NO: 2143 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHRDDEDKFFPQSGVLIFGKQGGAENNVEFERVMITDEEEIRTTNPVATEQYGSVSTNLQAGNAQAATADVN

SEQ ID NO: 2144 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 2145 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSADNNNSEYSWTGATKYHLNGRDSLVNPGPAMASHKDDEEKFFPQSGVLIFGKEGSGKSDAAIGDVMITDEEEIRTTNPVATEQYGSVSTNLQAGNAQAATADVN

SEQ ID NO: 2146 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDERFFPQSGVLIFGKQGAGTTDVEYGQVMITDEEEIRTTNPVATEQYGSVSTNLQAGNAQAATADVN

SEQ ID NO: 2147 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSEFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2148 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 2149 - protein, 334 aa, Artificial Sequence
  Synthetic
SSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGINTLSRLVFSQAGASDIRDQSRNWLPGPCYRQQRVSKVSADNNNSEFSWTGATKYHLNGRDSLVNPGPAMASHKDDEEKFFPQSGVLIFGKENGGGGDVAIGDVMITDEEEIRTTNPVATEQYGSVSTNLQAGNAQAATADVN

SEQ ID NO: 2150 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHKDDADKFFPQSGVLIFGKQNATGTNVDVGSVMITDEEEIRTTNPVATEQYGSVSTNLQAGNAQAATADVN

SEQ ID NO: 2151 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGIATKSELRFSQAGASDIRDQSRNWLPGPCYRQQRVSKQDAENNNSEFSWPGATKYHLNGRDSLVNPGPAMASHKDDEEKFFPQSGVLIFGKQGAGKDDIAIDNVMITDEEEIRTTNPVATEQYGSVSTNLQAGNAQAATADVN

SEQ ID NO: 2152 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSKLSFSQAGASDIRDQSRNWLPGPCYRQQRVSKTSADNNNSEYSWTGATKYHLNGRDSLVNPGPAMASHKDDEEKFFPQSGVLIFGKEGAAGNDVEFDQVMITDEEEIRTTNPVATEQYGSVSTNLQRGNRQAATADVN

SEQ ID NO: 2153 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRGQAAVQSVE

SEQ ID NO: 2154 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTSADNNNSEYSWTGATKYHLNGRDSLVNPGPAMASHGDDAERFFPQSGVLIFGKEGAGKTDVAIGRVMITDEEEIRTTNPVATEQYGSVSTNLQAGNAQAATADVN

SEQ ID NO: 2155 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDAEKFFPQSGVLIFGKQGSEKTNVDIEKVMITDEEEIRTTNPVATEQYGSVSTNLQAGNAQAATADVN

SEQ ID NO: 2156 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGHVTPSRLLFSQAGASDIRDQSRNWLPGPCYRQQRVSKQDGGNNNSDFSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 2157 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSSGRATPSALSFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATRDVH

SEQ ID NO: 2158 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSSSGSLTKSHLEFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2159 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNGKFFPQSGVLIFGKQSSGKSNIAIEGVMITDEEEIRTTNPVATEQYGSVSTNLQAGNAQAATADVN

SEQ ID NO: 2160 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPARNNNSNFSWTGATTYHLNGRDSLVNPGPAMASHEDDDGKFFPQSGVLIFGKESAGRSNVDVDRVMITDEEEIRTTNPVATEQYGSVSTNLQAGNAQAATADVN

SEQ ID NO: 2161 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTAQAQAAAPDVT

SEQ ID NO: 2162 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHGDDKDKFFPQSGVLIFGKQGSEKTNVDIEKVMITDEEEIRTTNPVATEQYGSVSTNLQAGNAQAATADVN

SEQ ID NO: 2163 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2164 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSKKYTDNNNSNFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2165 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEGRSAAAVNTVP

SEQ ID NO: 2166 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSKTSADNNNSEYSWTGATKYHLNGRDSLVNPGPAMASHKDDEEKFFPQSGVLIFGKESTSTANVEIEKVMITDEEEIRTTNPVATEQYGSVSTNLQAGNAQAATADVN

SEQ ID NO: 2167 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARTGPTTMSALNFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2168 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGASGSVTKSTLRFSQAGASDIRDQSRNWLPGPCYRQQRVSKTSADNNNSNFSWTGATKYHLNGRDSLVNPGPAMASHRDDEDKFFPQSGVLIFGKESSSGTDIAIGEVMITDEEEIRTTNPVATEQYGSVSTNLQAGNAQAATADVN

SEQ ID NO: 2169 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNQTNSRLVFSQAGASDIRDQSRNWLPGPCYRQQRVSKTDDDNNNSDFSWTGATKYHLNGRDSLVNPGPAMASHKDDDGKFFPQSGVLIFGKEGARGADIDIGDVMITDEEEIRTTNPVATEQYGSVSTNLQAGNAQAATADVN

SEQ ID NO: 2170 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGIATKSQLRFSQAGASDIRDQSRNWLPGPCYRQQRVSKTSADNNNSEYSWTGATKYHLNGRDSLVNPGPAMASHRDDEDKFFPQSGVLIFGKQGSAASNADVGQVMITDEEEIRTTNPVATEQYGSVSTNLQAGNAQAATADVN

SEQ ID NO: 2171 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKQDTDNNNSEFSWTGATKYHLNGRDSLVNPGPAMASHRDDDDKFFPQSGVLIFGKQNSAGNDAAVDEVMITDEEEIRTTNPVATEQYGSVSTNLQAGNAQAATADVN

SEQ ID NO: 2172 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAGGLLTTSALKFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2173 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKPKDAAATEAVA

SEQ ID NO: 2174 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGDNDRAASEEVQ

SEQ ID NO: 2175 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEDGKGNNVAFEKVMITDEEEIRTTNPVATEQYGSVSTNLQAGNAQAATADVN

SEQ ID NO: 2176 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLKFSQAGASDIRDQSRNWLPGPCYRQQRVSTQASHNNNSEFSWTGATKYHLNGRDSLVNPGPAMASHEDDTDKFFPQSGVLIFGKQGTGGNDAEIDDVMITDEEEIRTTNPVATEQYGSVSTNLQAGNAQAATADVN

SEQ ID NO: 2177 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTTSSENNNSDFSWTGATKYHLNGRDSLVNPGPAMASHEDDEGKFFPQSGVLIFGKQGSEKTNVDIEKVMITDEEEIRTTNPVATEQYGSVSTNLQAGNAQAATADVN

SEQ ID NO: 2178 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGEAGPLTLSNLRFSQAGASDIRDQSRNWLPGPCYRQQRVSKTDDDNNNSDFSWTGATKYHLNGRDSLVNPGPAMASHRDDEDKFFPQSGVLIFGKQNTGGGNVDIEHVMITDEEEIRTTNPVATEQYGSVSTNLQAGNAQAATADVN

SEQ ID NO: 2179 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2180 - protein, 334 aa, Artificial Sequence
  Synthetic
DTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 2181 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSDGNNNSDFSWTGATTYHLNGRDSLVNPGPAMASHKDDDDRFFPQSGVLIFGKQDARRNNAEIGSVMITDEEEIRTTNPVATEQYGSVSTNLQAGNAQAATADVN

SEQ ID NO: 2182 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQDSGGTNVDIGHVMITDEEEIRTTNPVATEQYGSVSTNLQAGNAQAATADVN

SEQ ID NO: 2183 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGRFFPQSGVLIFGKQDTGKGDVAIEHVMITDEEEIRTTNPVATEQYGSVSTNLQAGNAQAATADVN

SEQ ID NO: 2184 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDKDRFFPQSGVLIFGKQGSEKTNVDIEKVMITDEEEIRTTNPVATEQYGSVSTNLQAGNAQAATADVN

SEQ ID NO: 2185 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDDDKFFPQSGVLIFGKQSAKAANAAIDEVMITDEEEIRTTNPVATEQYGSVSTNLQAGNAQAATADVN

SEQ ID NO: 2186 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTAGHVTKSGLGFSQAGASDIRDQSRNWLPGPCYRQQRVSKTSADNNNSDFSWTGATKYHLNGRDSLVNPGPAMASHGDDADKFFPQSGVLIFGKQGSEKTNVDIEKVMITDEEEIRTTNPVATEQYGSVSTNLQAGNAQAATADVN

SEQ ID NO: 2187 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNKTLSRLKFSQAGASDIRDQSRNWLPGPCYRQQRVSTTSNENNNSDFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2188 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESAGGDNVEVERVMITDEEEIRTTNPVATEQYGSVSTNLQAGNAQAATADVN

SEQ ID NO: 2189 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKEDAGTTNVAFDKVMITDEEEIRTTNPVATEQYGSVSTNLQAGNAQAATADVN

SEQ ID NO: 2190 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKEGGGGTNVEIGEVMITDEEEIRTTNPVATEQYGSVSTNLQAGNAQAATADVN

SEQ ID NO: 2191 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 2192 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPTRNNNSEFSWTGATKYHLNGRDSLVNPGPAMASHEDDNGKFFPQSGVLIFGKQGSEKTNVDIEKVMITDEEEIRTTNPVATEQYGSVSTNLQAGNAQAATADVN

SEQ ID NO: 2193 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNQTNSRLVFSQAGASDIRDQSRNWLPGPCYRQQRVSTQPTENNNSDFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 2194 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2195 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGKFFPQSGVLIFGKQGSEKTNVDIEKVMITDEEEIRTTNPVATEQYGSVSTNLQRGNRQAATADVN

SEQ ID NO: 2196 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKEGGRAADAAFEEVMITDEEEIRTTNPVATEQYGSVSTNLQAGNAQAATADVN

SEQ ID NO: 2197 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRRDAAATAGVE

SEQ ID NO: 2198 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGKSGAAFAGVD

SEQ ID NO: 2199 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDDGKFFPQSGVLIFGKENTNGSDVAYESVMITDEEEIRTTNPVATEQYGSVSTNLQAGNAQAATADVN

SEQ ID NO: 2200 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARTGPTTMSALNFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2201 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 2202 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQARNARAASRDVD

SEQ ID NO: 2203 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGNITLSKLRFSQAGASDIRDQSRNWLPGPCYRQQRVSKQSDRNNNSEFSWTGATKYHLNGRDSLVNPGPAMASHKDDDDRFFPQSGVLIFGKQGANKADIAYDHVMITDEEEIRTTNPVATEQYGSVSTNLQAGNAQAATADVN

SEQ ID NO: 2204 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARAGPTTLSGLVFSQAGASDIRDQSRNWLPGPCYRQQRVSKVSADNNNSEFSWTGATKYHLNGRDSLVNPGPAMASHKDDEEKFFPQSGVLIFGKESAGTNNVDIERVMITDEEEIRTTNPVATEQYGSVSTNLQAGNAQAATADVN

SEQ ID NO: 2205 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGAGKTDVAIGRVMITDEEEIRTTNPVATEQYGSVSTNLQAGNAQAATADVN

SEQ ID NO: 2206 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGHATTSRLGFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2207 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKKDSRNNNSDFSWTGATKYHLNGRDSLVNPGPAMASHKDDDDRFFPQSGVLIFGKQDATATNADYEHVMITDEEEIRTTNPVATEQYGSVSTNLQAGNAQAATADVN

SEQ ID NO: 2208 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGATRANVAIDEVMITDEEEIRTTNPVATEQYGSVSTNLQAGNAQAATADVN

SEQ ID NO: 2209 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAATGNTTPSPLRFSQAGASDIRDQSRNWLPGPCYRQQRVSKTSADNNNSEYSWTGATKYHLNGRDSLVNPGPAMASHRDDNEKFFPQSGVLIFGKQDGNGSDIDYEEVMITDEEEIRTTNPVATEQYGSVSTNLQAGNAQAATADVN

SEQ ID NO: 2210 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGITTTSALKFSQAGASDIRDQSRNWLPGPCYRQQRVSKTDGENNNSEFSWTGATTYHLNGRDSLVNPGPAMASHRDDEDKFFPQSGVLIFGKQSSGKTDVDFGGVMITDEEEIRTTNPVATEQYGSVSTNLQAGNAQAATADVN

SEQ ID NO: 2211 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGKGPAADKNVD

SEQ ID NO: 2212 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDAKGTNIDFDGVMITDEEEIRTTNPVATEQYGSVSTNLQAGNAQAATADVN

SEQ ID NO: 2213 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDGGGADVAIDKVMITDEEEIRTTNPVATEQYGSVSTNLQAGNAQAATADVN

SEQ ID NO: 2214 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHRDDNEKFFPQSGVLIFGKQGSEKTNVDIEKVMITDEEEIRTTNPVATEQYGSVSTNLQAGNAQAATADVN

SEQ ID NO: 2215 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHMTMSGLRFSQAGASDIRDQSRNWLPGPCYRQQRVSKTAADNNNSDFSWTGATKYHLNGRDSLVNPGPAMASHKDDDGKFFPQSGVLIFGKEDAAKANAEIEQVMITDEEEIRTTNPVATEQYGSVSTNLQAGNAQAATADVN

SEQ ID NO: 2216 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNESGSDTHSRLKFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2217 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHRDDTGKFFPQSGVLIFGKQDGGKTNVDYEQVMITDEEEIRTTNPVATEQYGSVSTNLQAGNAQAATADVN

SEQ ID NO: 2218 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPRNRAAANGVD

SEQ ID NO: 2219 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDAGRFFPQSGVLIFGKQGSEKTNVDIEKVMITDEEEIRTTNPVATEQYGSVSTNLQAGNAQAATADVN

SEQ ID NO: 2220 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQCTGKDNVAIGGVMITDEEEIRTTNPVATEQYGSVSTNLQAGNAQAATADVN

SEQ ID NO: 2221 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGRTPAAAQDVD

SEQ ID NO: 2222 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2223 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGSATNSRLRFSQAGASDIRDQSRNWLPGPCYRQQRVSTTPADNNNSDFSWTGATKYHLNGRDSLVNPGPAMASHKDDDEKFFPQSGVLIFGKESSAGGDAAFDQVMITDEEEIRTTNPVATEQYGSVSTNLQAGNAQAATADVN

SEQ ID NO: 2224 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 2225 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQRGNRQAATADVN

SEQ ID NO: 2226 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGRMTPSGLQFSQAGASDIRDQSRNWLPGPCYRQQRVSKTATRNNNSDFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 2227 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDEGRFFPQSGVLIFGKQNGEKGNIDIEGVMITDEEEIRTTNPVATEQYGSVSTNLQAGNAQAATADVN

SEQ ID NO: 2228 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRRSSAAFEGVD

SEQ ID NO: 2229 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKTYNDNNNSEFSWTGATTYHLNGRDSLVNPGPAMASHKDDDERFFPQSGVLIFGKQDAKRDNAAFDQVMITDEEEIRTTNPVATEQYGSVSTNLQAGNAQAATADVN

SEQ ID NO: 2230 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTTHGRNNNSNFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 2231 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGHTNAAFEGVA

SEQ ID NO: 2232 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAARTDAAAKDVH

SEQ ID NO: 2233 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQGGIATQSRLKFSQAGASDIRDQSRNWLPGPCYRQQRVSKQASDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2234 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKTGSLTQSSLKFSQAGASDIRDQSRNWLPGPCYRQQRVSKQASDNNNSEFSWTGATKYHLNGRDSLVNPGPAMASHKDDEEKFFPQSGVLIFGKEDGSRNDVDIEKVMITDEEEIRTTNPVATEQYGSVSTNLQAGNAQAATADVN

SEQ ID NO: 2235 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRQSNAAASTRVD

SEQ ID NO: 2236 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2237 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNSGTLTISNLRFSQAGASDIRDQSRNWLPGPCYRQQRVSTTPTGNNNSDFSWTGATKYHLNGRDSLVNPGPAMASHKDDDDRFFPQSGVLIFGKQGSGASNVAYGEVMITDEEEIRTTNPVATEQYGSVSTNLQAGNAQAATADVN

SEQ ID NO: 2238 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESTKKTDVAIGDVMITDEEEIRTTNPVATEQYGSVSTNLQAGNAQAATADVN

SEQ ID NO: 2239 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKTDGENNNSDFSWTGATKYHLNGRDSLVNPGPAMASHKDDEEKFFPQSGVLIFGKENGTASDVAFEEVMITDEEEIRTTNPVATEQYGSVSTNLQAGNAQAATADVN

SEQ ID NO: 2240 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDTAKGNAAVDQVMITDEEEIRTTNPVATEQYGSVSTNLQAGNAQAATADVN

SEQ ID NO: 2241 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 2242 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTPNDNNNSNFSWTGATKYHLNGRDSLVNPGPAMASHEDDKDKFFPQSGVLIFGKQGSEKTNVDIEKVMITDEEEIRTTNPVATEQYGSVSTNLQAGNAQAATADVN

SEQ ID NO: 2243 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSMTMSTLKFSQAGASDIRDQSRNWLPGPCYRQQRVSKPHDDNNNSDFSWPGATKYHLNGRDSLVNPGPAMASHEDDDDKFFPQSGVLIFGKQSAGRGDAEIGQVMITDEEEIRTTNPVATEQYGSVSTNLQAGNAQAATADVN

SEQ ID NO: 2244 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESTKAANTDIDHVMITDEEEIRTTNPVATEQYGSVSTNLQAGNAQAATADVN

SEQ ID NO: 2245 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGTKTLSRLGFSQAGASDIRDQSRNWLPGPCYRQQRVSKQPAGNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2246 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDRGGPITLSALRFSQAGASDIRDQSRNWLPGPCYRQQRVSTQPTDNNNSEFSWTGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 2247 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLKFSQAGASDIRDQSRNWLPGPCYRQQRVSKTHGENNNSDFSWTGATKYHLNGRDSLVNPGPAMASHKDDDDKFFPQSGVLIFGKQGAGTSDVAFGNVMITDEEEIRTTNPVATEQYGSVSTNLQAGNAQAATADVN

SEQ ID NO: 2248 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARGQAASATVT

SEQ ID NO: 2249 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKQDTDNNNSNFSWTGATKYHLNGRDSLVNPGPAMASHKDDDDRFFPQSGVLIFGKEDATKTDVEIGKVMITDEEEIRTTNPVATEQYGSVSTNLQAGNAQAATADVN

SEQ ID NO: 2250 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKEGTRKNNVDIEQVMITDEEEIRTTNPVATEQYGSVSTNLQAGNAQAATADVN

SEQ ID NO: 2251 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATKYHLNGRDSLVNPGPAMASHKDDNDRFFPQSGVLIFGKEDSRKSNADIEGVMITDEEEIRTTNPVATEQYGSVSTNLQAGNAQAATADVN

SEQ ID NO: 2252 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHRDDNGKFFPQSGVLIFGKQGSGKSNVAFGDVMITDEEEIRTTNPVATEQYGSVSTNLQAGNAQAATADVN

SEQ ID NO: 2253 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDAGRNDVAIDKVMITDEEEIRTTNPVATEQYGSVSTNLQAGNAQAATADVN

SEQ ID NO: 2254 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKESTAKGNIEFEGVMITDEEEIRTTNPVATEQYGSVSTNLQAGNAQAATADVN

SEQ ID NO: 2255 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGHVTKSKLVFSQAGASDIRDQSRNWLPGPCYRQQRVSKKDTDNNNSEFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 2256 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRSGSTTTSRLNFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2257 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESGGTDNVDIDRVMITDEEEIRTTNPVATEQYGSVSTNLQAGNAQAATADVN

SEQ ID NO: 2258 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGTRKNNVDIEQVMITDEEEIRTTNPVATEQYGSVSTNLQAGNAQAATADVN

SEQ ID NO: 2259 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGNMTKSTLEFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2260 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGRTGNDTLSQLRFSQAGASDIRDQSRNWLPGPCYRQQRVSKTSADNNNSNFSWTGATKYHLNGRDSLVNPGPAMASHRDDEDKFFPQSGVLIFGKEGTRKNNVDIEQVMITDEEEIRTTNPVATEQYGSVSTNLQAGNAQAATADVN

SEQ ID NO: 2261 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRDRDTAADAIVQ

SEQ ID NO: 2262 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKQSADGSDVDIDRVMITDEEEIRTTNPVATEQYGSVSTNLQAGNAQAATADVN

SEQ ID NO: 2263 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRSGAAVRDVH

SEQ ID NO: 2264 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRTGIKTPSDLKFSQAGASDIRDQSRNWLPGPCYRQQRVSKQPNDNNNSEFSWTGATTYHLNGRDSLVNPGPAMASHGDDNEKFFPQSGVLIFGKQGATGSDVAIEHVMITDEEEIRTTNPVATEQYGSVSTNLQAGNAQAATADVN

SEQ ID NO: 2265 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2266 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGSVTMSTLLFSQAGASDIRDQSRNWLPGPCYRQQRVSKQPSQNNNSNFSWTGATKYHLNGRDSLVNPGPAMASHKDDDEKFFPQSGVLIFGKQDAGKANIDIDGVMITDEEEIRTTNPVATEQYGSVSTNLQAGNAQAATADVN

SEQ ID NO: 2267 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNGGRETLSRLKFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2268 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2269 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKGKFFPQSGVLIFGKENAEGADVDIEKVMITDEEEIRTTNPVATEQYGSVSTNLQAGNAQAATADVN

SEQ ID NO: 2270 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEGTSKDNVAFDQVMITDEEEIRTTNPVATEQYGSVSTNLQAGNAQAATADVN

SEQ ID NO: 2271 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 2272 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQAGNAQAATADVN

SEQ ID NO: 2273 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGGDKANADIDDVMITDEEEIRTTNPVATEQYGSVSTNLQAGNAQAATADVN

SEQ ID NO: 2274 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGGGATDVEIEGVMITDEEEIRTTNPVATEQYGSVSTNLQAGNAQAATADVN

SEQ ID NO: 2275 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHRDDDEKFFPQSGVLIFGKQDSEKTNVDIEKVMITDEEEIRTTNPVATEQYGSVSTNLQAGNAQAATADVN

SEQ ID NO: 2276 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKGRFFPQSGVLIFGKQDAGKSNADIDRVMITDEEEIRTTNPVATEQYGSVSTNLQAGNAQAATADVN

SEQ ID NO: 2277 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKEGATGANVDIEGVMITDEEEIRTTNPVATEQYGSVSTNLQAGNAQAATADVN

SEQ ID NO: 2278 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNDTTSNLGFSQAGASDIRDQSRNWLPGPCYRQQRVSTTAGDNNNSNFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 2279 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTFADNNNSEYSWTGATKYHLNGRDSLVNPGPAMASHGDDDERFFPQSGVLIFGKQGASETNVEIDKVMITDEEEIRTTNPVATEQYGSVSTNLQAGNAQAATADVN

SEQ ID NO: 2280 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGSLTQSRLRFSQAGASDIRDQSRNWLPGPCYRQQRVSTTANENNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2281 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGGGGNNIEIERVMITDEEEIRTTNPVATEQYGSVSTNLQRGNRQAATADVN

SEQ ID NO: 2282 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNKTISELSFSQAGASDIRDQSRNWLPGPCYRQQRVSTTSNENNNSEFSWTGATTYHLNGRDSLVNPGPAMASHKDDDDRFFPQSGVLIFGKEGAGANDVAVEHVMITDEEEIRTTNPVATEQYGSVSTNLQAGNAQAATADVN

SEQ ID NO: 2283 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNATGRPTKSALRFSQAGASDIRDQSRNWLPGPCYRQQRVSKTSADNNNSNFSWTGATKYHLNGRDSLVNPGPAMASHRDDEDKFFPQSGVLIFGKQDGARDDAAIEDVMITDEEEIRTTNPVATEQYGSVSTNLQAGNAQAATADVN

SEQ ID NO: 2284 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2285 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNSGILTTSTLRFSQAGASDIRDQSRNWLPGPCYRQQRVSKQPSQNNNSNFSWTGATKYHLNGRDSLVNPGPAMASHGDDEGRFFPQSGVLIFGKQGSEKTNVDIEKVMITDEEEIRTTNPVATEQYGSVSTNLQAGNAQAATADVN

SEQ ID NO: 2286 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDEEKFFPQSGVLIFGKQDAGTANVDFGGVMITDEEEIRTTNPVATEQYGSVSTNLQAGNAQAATADVN

SEQ ID NO: 2287 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQNTAGNDVDIERVMITDEEEIRTTNPVATEQYGSVSTNLQAGNAQAATADVN

SEQ ID NO: 2288 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHRDDDEKFFPQSGVLIFGKQSAKAANAAIDEVMITDEEEIRTTNPVATEQYGSVSTNLQAGNAQAATADVN

SEQ ID NO: 2289 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSSGADNVEVEGVMITDEEEIRTTNPVATEQYGSVSTNLQAGNAQAATADVN

SEQ ID NO: 2290 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKESTGENNVDVERVMITDEEEIRTTNPVATEQYGSVSTNLQAGNAQAATADVN

SEQ ID NO: 2291 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDGGNNNSEFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 2292 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGIMTLSELRFSQAGASDIRDQSRNWLPGPCYRQQRVSTTPADNNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2293 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKEGGSRTNAAVGDVMITDEEEIRTTNPVATEQYGSVSTNLQAGNAQAATADVN

SEQ ID NO: 2294 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWPGATKYHLNGRDSLVNPGPAMASHKDDDDKFFPQSGVLIFGKEGTTGNDVDVESVMITDEEEIRTTNPVATEQYGSVSTNLQAGNAQAATADVN

SEQ ID NO: 2295 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKQSTTGANVDVEQVMITDEEEIRTTNPVATEQYGSVSTNLQAGNAQAATADVN

SEQ ID NO: 2296 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDAGRNDVAIDKVMITDEEEIRTTNPVATEQYGSVSTNLQAGNAQAATADVN

SEQ ID NO: 2297 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDARGANVDVGNVMITDEEEIRTTNPVATEQYGSVSTNLQAGNAQAATADVN

SEQ ID NO: 2298 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGILTQSTLRFSQAGASDIRDQSRNWLPGPCYRQQRVSKQASDNNNSNFSWTGATTYHLNGRDSLVNPGPAMASHKDDEGRFFPQSGVLIFGKQDAGATDVEVDEVMITDEEEIRTTNPVATEQYGSVSTNLQRGNRQAATADVN

SEQ ID NO: 2299 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPSENNNSDFSWTGATTYHLNGRDSLVNPGPAMASHRDDEDRFFPQSGVLIFGKEGASTANVAIGQVMITDEEEIRTTNPVATEQYGSVSTNLQAGNAQAATADVN

SEQ ID NO: 2300 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGAGKTDIAFEGVMITDEEEIRTTNPVATEQYGSVSTNLQAGNAQAATADVN

SEQ ID NO: 2301 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGHRDGAAFRAVQ

SEQ ID NO: 2302 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKPRDGAADRIVN

SEQ ID NO: 2303 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDEKFFPQSGVLIFGKEGATRGDTEIDRVMITDEEEIRTTNPVATEQYGSVSTNLQAGNAQAATADVN

SEQ ID NO: 2304 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 2305 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSKTHGDNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2306 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSHRGEAAFDVVT

SEQ ID NO: 2307 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIDRVMITDEEEIRTTNPVATEQYGSVSTNLQRGNRQAATADVN

SEQ ID NO: 2308 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDEEKFFPQSGVLIFGKEDGGGSNVEIGRVMITDEEEIRTTNPVATEQYGSVSTNLQAGNAQAATADVN

SEQ ID NO: 2309 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRDQAAIAEVT

SEQ ID NO: 2310 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNKTGHLTTSALRFSQAGASDIRDQSRNWLPGPCYRQQRVSKTSADNNNSNFSWTGATKYHLNGRDSLVNPGPAMASHKDDEGKFFPQSGVLIFGKQGTKKTNAEIEDVMITDEEEIRTTNPVATEQYGSVSTNLQAGNAQAATADVN

SEQ ID NO: 2311 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQSGTMTMSRLHFSQAGASDIRDQSRNWLPGPCYRQQRVSKTAARNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2312 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNAKAAAAVGEVH

SEQ ID NO: 2313 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTDNNNSNFSWTGATTYHLNGRDSLVNPGPAMASHKDDDDRFFPQSGVLIFGKQSAKAANAAIDEVMITDEEEIRTTNPVATEQYGSVSTNLQAGNAQAATADVN

SEQ ID NO: 2314 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTDRNHAAFDEVN

SEQ ID NO: 2315 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 2316 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGLTTNSPLKFSQAGASDIRDQSRNWLPGPCYRQQRVSKVSADNNNSEFSWTGATKYHLNGRDSLVNPGPAMASHKDDEEKFFPQSGVLIFGKEGATRTDTDYDQVMITDEEEIRTTNPVATEQYGSVSTNLQAGNAQAATADVN

SEQ ID NO: 2317 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHVTQSRLLFSQAGASDIRDQSRNWLPGPCYRQQRVSKTSAENNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2318 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKESGEASNVDVDGVMITDEEEIRTTNPVATEQYGSVSTNLQAGNAQAATADVN

SEQ ID NO: 2319 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDAENNNSEFSWPGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 2320 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGRSQAANRDVD

SEQ ID NO: 2321 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHKDDDEKFFPQSGVLIFGKQGAGASNVDFDRVMITDEEEIRTTNPVATEQYGSVSTNLQAGNAQAATADVN

SEQ ID NO: 2322 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2323 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGRPTQSDLGFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2324 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSQTKSELQFSQAGASDIRDQSRNWLPGPCYRQQRVSKQSADNNNSDFSWTGATKYHLNGRDSLVNPGPAMASHKDDADKFFPQSGVLIFGKEGAAKGNVAFESVMITDEEEIRTTNPVATEQYGSVSTNLQAGNAQAATADVN

SEQ ID NO: 2325 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDEEKFFPQSGVLIFGKQGAGRGNTAIDDVMITDEEEIRTTNPVATEQYGSVSTNLQAGNAQAATADVN

SEQ ID NO: 2326 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGRTAAADTMVD

SEQ ID NO: 2327 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGRKTTSELQFSQAGASDIRDQSRNWLPGPCYRQQRVSTTPNENNNSDFSWTGATKYHLNGRDSLVNPGPAMASHRDDEEKFFPQSGVLIFGKQGSEKTNVDIEKVMITDEEEIRTTNPVATEQYGSVSTNLQAGNAQAATADVN

SEQ ID NO: 2328 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGIKTPSRLGFSQAGASDIRDQSRNWLPGPCYRQQRVSKTDGENNNSDFSWTGATKYHLNGRDSLVNPGPAMASHKDDEEKFFPQSGVLIFGKQDAAGSNVAIDEVMITDEEEIRTTNPVATEQYGSVSTNLQAGNAQAATADVN

SEQ ID NO: 2329 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNEKFFPQSGVLIFGKQSAGANNVEIESVMITDEEEIRTTNPVATEQYGSVSTNLQRGNRQAATADVN

SEQ ID NO: 2330 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNHAGLATLSTLEFSQAGASDIRDQSRNWLPGPCYRQQRVSKTDGENNNSDFSWTGATKYHLNGRDSLVNPGPAMASHKDDEEKFFPQSGVLIFGKESGKASNVAIGEVMITDEEEIRTTNPVATEQYGSVSTNLQAGNAQAATADVN

SEQ ID NO: 2331 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 2332 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNQTNSALGFSQAGASDIRDQSRNWLPGPCYRQQRVSTKATDNNNSNFSWTGATTYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 2333 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEDAGRGDVDIGNVMITDEEEIRTTNPVATEQYGSVSTNLQAGNAQAATADVN

SEQ ID NO: 2334 - protein, 334 aa, Artificial Sequence; identical to SEQ ID NO: 450
  Synthetic

SEQ ID NO: 2335 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGRFFPQSGVLIFGKEGTGTGNVEIDSVMITDEEEIRTTNPVATEQYGSVSTNLQAGNAQAATADVN

SEQ ID NO: 2336 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSEFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 2337 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNKTMSRLQFSQAGASDIRDQSRNWLPGPCYRQQRVSKQPSENNNSDFSWTGATKYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 2338 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSKQPSQNNNSNFSWTGATKYHLNGRDSLVNPGPAMASHKDDDERFFPQSGVLIFGKEGAGTNDIDIERVMITDEEEIRTTNPVATEQYGSVSTNLQAGNAQAATADVN

SEQ ID NO: 2339 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDTDNNNSEFSWTGATTYHLNGRDSLVNPGPAMASHKDDDDKFFPQSGVLIFGKESGAKANAAVEHVMITDEEEIRTTNPVATEQYGSVSTNLQAGNAQAATADVN

SEQ ID NO: 2340 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGATADNVAFDGVMITDEEEIRTTNPVATEQYGSVSTNLQAGNAQAATADVN

SEQ ID NO: 2341 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEEKFFPQSGVLIFGKQGASKNNIAIGDVMITDEEEIRTTNPVATEQYGSVSTNLQAGNAQAATADVN

SEQ ID NO: 2342 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNAGTKTQSKLQFSQAGASDIRDQSRNWLPGPCYRQQRVSKQANHNNNSEFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 2343 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKQNTGGGNVDIDGVMITDEEEIRTTNPVATEQYGSVSTNLQAGNAQAATADVN

SEQ ID NO: 2344 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQSSGKSNIAIEGVMITDEEEIRTTNPVATEQYGSVSTNLQAGNAQAATADVN

SEQ ID NO: 2345 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSTTPGGNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2346 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRPNTSAAFNEVD

SEQ ID NO: 2347 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGTITKSNLMFSQAGASDIRDQSRNWLPGPCYRQQRVSKVSADNNNSEFSWTGATKYHLNGRDSLVNPGPAMASHKDDEEKFFPQSGVLIFGKEGTEKSNVAIERVMITDEEEIRTTNPVATEQYGSVSTNLQAGNAQAATADVN

SEQ ID NO: 2348 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSTTPGGNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 2349 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGRGGNQTKSELHFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2350 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKQGAGKNNAAIGQVMITDEEEIRTTNPVATEQYGSVSTNLQAGNAQAATADVN

SEQ ID NO: 2351 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQASSNHAAAKGVD

SEQ ID NO: 2352 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNATHSQLRFSQAGASDIRDQSRNWLPGPCYRQQRVSKTDGENNNSDFSWTGATTYHLNGRDSLVNPGPAMASHEDDNGKFFPQSGVLIFGKQGSEKTNVDIEKVMITDEEEIRTTNPVATEQYGSVSTNLQAGNAQAATADVN

SEQ ID NO: 2353 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKQSGTRANVAIGEVMITDEEEIRTTNPVATEQYGSVSTNLQAGNAQAATADVN

SEQ ID NO: 2354 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGRAAAATGEVH

SEQ ID NO: 2355 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2356 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDDSGIHTKSKLKFSQAGASDIRDQSRNWLPGPCYRQQRVSKQPNDNNNSEFSWTGATTYHLNGRDSLVNPGPAMASHKDDNEKFFPQSGVLIFGKENGGGANIDIGQVMITDEEEIRTTNPVATEQYGSVSTNLQAGNAQAATADVN

SEQ ID NO: 2357 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQGGIATQSRLKFSQAGASDIRDQSRNWLPGPCYRQQRVSKQSADNNNSDFSWTGATKYHLNGRDSLVNPGPAMASHKDDADKFFPQSGVLIFGKQNTGGNNTDIDNVMITDEEEIRTTNPVATEQYGSVSTNLQAGNAQAATADVN

SEQ ID NO: 2358 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKEGSEKNDVEFEQVMITDEEEIRTTNPVATEQYGSVSTNLQRGNRQAATADVN

SEQ ID NO: 2359 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTHSRLRFSQAGASDIRDQSRNWLPGPCYRQQRVSKQANHNNNSEFSWTGATTYHLNGRDSLVNPGPAMASHKDDDEKFFPQSGVLIFGKENGEAGNVDIDQVMITDEEEIRTTNPVATEQYGSVSTNLQAGNAQAATADVN

SEQ ID NO: 2360 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDSGRANVDFEKVMITDEEEIRTTNPVATEQYGSVSTNLQAGNAQAATADVN

SEQ ID NO: 2361 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKENTTGNDAEIGQVMITDEEEIRTTNPVATEQYGSVSTNLQAGNAQAATADVN

SEQ ID NO: 2362 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSTAGTQTHSRLGFSQAGASDIRDQSRNWLPGPCYRQQRVSKTSGGNNNSEFSWPGATTYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 2363 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 2364 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKQGGTGGNTDIEGVMITDEEEIRTTNPVATEQYGSVSTNLQAGNAQAATADVN

SEQ ID NO: 2365 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2366 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKEGTGRANVAIEGVMITDEEEIRTTNPVATEQYGSVSTNLQAGNAQAATADVN

SEQ ID NO: 2367 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 2368 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHTDDEEKFFPQSGVLIFGKQGSEKTNVDIEKVMITDEEEIRTTNPVATEQYGSVSTNLQRDRDEAAVGGVN

SEQ ID NO: 2369 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDSTEGDVDIGKVMITDEEEIRTTNPVATEQYGSVSTNLQAGNAQAATADVN

SEQ ID NO: 2370 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGTGGSNADVEKVMITDEEEIRTTNPVATEQYGSVSTNLQAGNAQAATADVN

SEQ ID NO: 2371 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASTGINTLSTLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2372 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2373 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKQDTDNNNSDFSWTGATKYHLNGRDSLVNPGPAMASHKDDDDRFFPQSGVLIFGKQGSGKSNVAFGDVMITDEEEIRTTNPVATEQYGSVSTNLQAGNAQAATADVN

SEQ ID NO: 2374 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2375 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2376 - protein, 334 aa, Artificial Sequence; identical to SEQ ID NO: 336
  Synthetic

SEQ ID NO: 2377 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGAGIDTISQLLFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 2378 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGATRANIEIDDVMITDEEEIRTTNPVATEQYGSVSTNLQAGNAQAATADVN

SEQ ID NO: 2379 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2380 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGTVTTSHLRFSQAGASDIRDQSRNWLPGPCYRQQRVSTKDTDNNNSNFSWTGATKYHLNGRDSLVNPGPAMASHKDDNDKFFPQSGVLIFGKQSAARNDTAYENVMITDEEEIRTTNPVATEQYGSVSTNLQAGNAQAATADVN

SEQ ID NO: 2381 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEDGGATDVAVENVMITDEEEIRTTNPVATEQYGSVSTNLQAGNAQAATADVN

SEQ ID NO: 2382 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHMTMSGLRFSQAGASDIRDQSRNWLPGPCYRQQRVSKTAADNNNSDFSWTGATKYHLNGRDSLVNPGPAMASHKDDDGKFFPQSGVLIFGKEDAAKANAEIEQVMITDEEEIRTTNPVATEQYGSVSTNLQAGNAQAATADVN

SEQ ID NO: 2383 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSTSRGDVDIGGVMITDEEEIRTTNPVATEQYGSVSTNLQAGNAQAATADVN

SEQ ID NO: 2384 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSQTGIHTKSTLRFSQAGASDIRDQSRNWLPGPCYRQQRVSTQSTGNNNSDFSWTGATKYHLNGRDSLVNPGPAMASHKDDDERFFPQSGVLIFGKEGGGANDTDIEGVMITDEEEIRTTNPVATEQYGSVSTNLQAGNAQAATADVN

SEQ ID NO: 2385 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2386 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSGGNNNSNFSWTGATTYHLNGRDSLVNPGPAMASHKDDEEKFFPQSGVLIFGKENSTRTDAAIDEVMITDEEEIRTTNPVATEQYGSVSTNLQAGNAQAATADVN

SEQ ID NO: 2387 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGAKATDTEVEQVMITDEEEIRTTNPVATEQYGSVSTNLQAGNAQAATADVN

SEQ ID NO: 2388 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNDGGPATKSTLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2389 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDRFFPQSGVLIFGKQGAGKNDVEFEQVMITDEEEIRTTNPVATEQYGSVSTNLQAGNAQAATADVN

SEQ ID NO: 2390 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHMTMSGLRFSQAGASDIRDQSRNWLPGPCYRQQRVSKTAADNNNSDFSWTGATKYHLNGRDSLVNPGPAMASHKDDDGKFFPQSGVLIFGKEDAAKANAEIEQVMITDEEEIRTTNPVATEQYGSVSTNLQAGNAQAATADVN

SEQ ID NO: 2391 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDAERFFPQSGVLIFGKQGSEKTNVDIEKVMITDEEEIRTTNPVATEQYGSVSTNLQAGNAQAATADVN

SEQ ID NO: 2392 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHRTQAAVRNVD

SEQ ID NO: 2393 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGITTHSGLQFSQAGASDIRDQSRNWLPGPCYRQQRVSKTDGENNNSDFSWTGATKYHLNGRDSLVNPGPAMASHKDDEEKFFPQSGVLIFGKEGTRKNNVDIEQVMITDEEEIRTTNPVATEQYGSVSTNLQAGNAQAATADVN

SEQ ID NO: 2394 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDDERFFPQSGVLIFGKESATGDNVEIGQVMITDEEEIRTTNPVATEQYGSVSTNLQAGNAQAATADVN

SEQ ID NO: 2395 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHKDDDDRFFPQSGVLIFGKEGSNKTNIDIDRVMITDEEEIRTTNPVATEQYGSVSTNLQAGNAQAATADVN

SEQ ID NO: 2396 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2397 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNGGPTTQSTLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2398 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTQHTPAAAQEVE

SEQ ID NO: 2399 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGPATLSTLKFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2400 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSNFSWTGATKYHLNGRDSLVNPGPAMASHGDDNDRFFPQSGVLIFGKQDGRENNADIDGVMITDEEEIRTTNPVATEQYGSVSTNLQAGNAQAATADVN

SEQ ID NO: 2401 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPADNNNSDFSWTGATKYHLNGRDSLVNPGPAMASHKDDDEKFFPQSGVLIFGKENAGRGDIDIEKVMITDEEEIRTTNPVATEQYGSVSTNLQAGNAQAATADVN

SEQ ID NO: 2402 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2403 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDDRFFPQSGVLIFGKQDGSGGNTEIDGVMITDEEEIRTTNPVATEQYGSVSTNLQAGNAQAATADVN

SEQ ID NO: 2404 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTADHNNNSDFSWTGATKYHLNGRDSLVNPGPAMASHRDDEDKFFPQSGVLIFGKEDSAKGNTDIDNVMITDEEEIRTTNPVATEQYGSVSTNLQAGNAQAATADVN

SEQ ID NO: 2405 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 2406 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQAGLVTKSELMFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2407 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSNFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 2408 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAEADNAAFEKVMITDEEEIRTTNPVATEQYGSVSTNLQAGNAQAATADVN

SEQ ID NO: 2409 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDEDKFFPQSGVLIFGKESSNRDNVDIGQVMITDEEEIRTTNPVATEQYGSVSTNLQAGNAQAATADVN

SEQ ID NO: 2410 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGTGIVTKSGLKFSQAGASDIRDQSRNWLPGPCYRQQRVSKQSDRNNNSDFSWTGATKYHLNGRDSLVNPGPAMASHKDDDDRFFPQSGVLIFGKQGSEKTNVDIEKVMITDEEEIRTTNPVATEQYGSVSTNLQGQKDRAASTDVH

SEQ ID NO: 2411 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQDAGKSNADIDRVMITDEEEIRTTNPVATEQYGSVSTNLQAGNAQAATADVN

SEQ ID NO: 2412 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQRGNRQAATADVN

SEQ ID NO: 2413 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGPITLSALRFSQAGASDIRDQSRNWLPGPCYRQQRVSTQPTDNNNSEFSWTGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 2414 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSNFSWTGATKYHLNGRDSLVNPGPAMASHKDDDDKFFPQSGVLIFGKEGGGATDVEIEGVMITDEEEIRTTNPVATEQYGSVSTNLQAGNAQAATADVN

SEQ ID NO: 2415 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2416 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKKYTDNNNSNFSWTGATTYHLNGRDSLVNPGPAMASHEDDTDKFFPQSGVLIFGKQSAKAANAAIDEVMITDEEEIRTTNPVATEQYGSVSTNLQAGNAQAATADVN

SEQ ID NO: 2417 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRSGTATLSRLQFSQAGASDIRDQSRNWLPGPCYRQQRVSKTHGDNNNSEFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2418 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNKDPAADGVVA

SEQ ID NO: 2419 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 2420 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDEDKFFPQSGVLIFGKQGSRKGNVDIEEVMITDEEEIRTTNPVATEQYGSVSTNLQAGNAQAATADVN

SEQ ID NO: 2421 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQGAGANNVDFGQVMITDEEEIRTTNPVATEQYGSVSTNLQAGNAQAATADVN

SEQ ID NO: 2422 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKEGTTGTNIAVDDVMITDEEEIRTTNPVATEQYGSVSTNLQAGNAQAATADVN

SEQ ID NO: 2423 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGATGINTMSKLLFSQAGASDIRDQSRNWLPGPCYRQQRVSTTPADNNNSDFSWTGATKYHLNGRDSLVNPGPAMASHRDDEDKFFPQSGVLIFGKQGTGKNNIAFEDVMITDEEEIRTTNPVATEQYGSVSTNLQAGNAQAATADVN

SEQ ID NO: 2424 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGRVTISNLRFSQAGASDIRDQSRNWLPGPCYRQQRVSKPANGNNNSEFSWTGATKYHLNGRDSLVNPGPAMASHKDDDDRFFPQSGVLIFGKQGATKDDADIDQVMITDEEEIRTTNPVATEQYGSVSTNLQAGNAQAATADVN

SEQ ID NO: 2425 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGSHTTSGLGFSQAGASDIRDQSRNWLPGPCYRQQRVSTQDGENNNSDFSWTGATKYHLNGRDSLVNPGPAMASHKDDDGKFFPQSGVLIFGKQGSSRDDVDIGGVMITDEEEIRTTNPVATEQYGSVSTNLQAGNAQAATADVN

SEQ ID NO: 2426 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNAKTRAAFTTVD

SEQ ID NO: 2427 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEEKFFPQSGVLIFGKESSSATNIDIDRVMITDEEEIRTTNPVATEQYGSVSTNLQAGNAQAATADVN

SEQ ID NO: 2428 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNATTGNVTTSKLSFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2429 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKTSADNNNSNFSWTGATKYHLNGRDSLVNPGPAMASHRDDEDKFFPQSGVLIFGKQDTGKGDVAIEHVMITDEEEIRTTNPVATEQYGSVSTNLQAGNAQAATADVN

SEQ ID NO: 2430 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDAENNNSEFSWPGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2431 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQSTRAPAASTNVD

SEQ ID NO: 2432 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKEGSAGSNAAIDNVMITDEEEIRTTNPVATEQYGSVSTNLQAGNAQAATADVN

SEQ ID NO: 2433 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGSSGAAFGGVE

SEQ ID NO: 2434 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQGTQSRAADRGVN

SEQ ID NO: 2435 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGSEKTNVDIEKVMITDEEEIRTTNPVATEQYGSVSTNLQRGNRQAATADVN

SEQ ID NO: 2436 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKEGTGRANVAIEGVMITDEEEIRTTNPVATEQYGSVSTNLQAGNAQAATADVN

SEQ ID NO: 2437 - protein, 334 aa, Artificial Sequence; identical to SEQ ID NO: 407
  Synthetic

SEQ ID NO: 2438 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSAAAANIDFEHVMITDEEEIRTTNPVATEQYGSVSTNLQAGNAQAATADVN

SEQ ID NO: 2439 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSTKATDNNNSNFSWTGATTYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 2440 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGSATISKLKFSQAGASDIRDQSRNWLPGPCYRQQRVSTTASHNNNSDFSWTGATKYHLNGRDSLVNPGPAMASHKDDDEKFFPQSGVLIFGKQDTGTGDVDIGGVMITDEEEIRTTNPVATEQYGSVSTNLQAGNAQAATADVN

SEQ ID NO: 2441 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNAGHPTISELQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2442 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKQGTGKNNIAFEDVMITDEEEIRTTNPVATEQYGSVSTNLQAGNAQAATADVN

SEQ ID NO: 2443 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSAKTAAAFEDVN

SEQ ID NO: 2444 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQNASENNAAIEDVMITDEEEIRTTNPVATEQYGSVSTNLQAGNAQAATADVN

SEQ ID NO: 2445 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGHKTPSNLGFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2446 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2447 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSGGNNNSNFSWTGATKYHLNGRDSLVNPGPAMASHKDDDDRFFPQSGVLIFGKQGSGKANVEIGRVMITDEEEIRTTNPVATEQYGSVSTNLQAGNAQAATADVN

SEQ ID NO: 2448 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSELRFSQAGASDIRDQSRNWLPGPCYRQQRVSKQSGQNNNSDFSWTGATKYHLNGRDSLVNPGPAMASHKDDEGKFFPQSGVLIFGKEGTAGTDIDIDKVMITDEEEIRTTNPVATEQYGSVSTNLQAGNAQAATADVN

SEQ ID NO: 2449 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNAGGLATQSQLRFSQAGASDIRDQSRNWLPGPCYRQQRVSKTSADNNNSNFSWTGATKYHLNGRDSLVNPGPAMASHRDDEDKFFPQSGVLIFGKQGGTKTDAAYEEVMITDEEEIRTTNPVATEQYGSVSTNLQAGNAQAATADVN

SEQ ID NO: 2450 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAHTGTHTKSGLHFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRANTPAAFNIVD

SEQ ID NO: 2451 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKQHNQNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 2452 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 2453 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENSGTNNAEIDNVMITDEEEIRTTNPVATEQYGSVSTNLQAGNAQAATADVN

SEQ ID NO: 2454 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAAGNMTMSALLFSQAGASDIRDQSRNWLPGPCYRQQRVSTTANHNNNSNFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2455 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGSMTNSGLRFSQAGASDIRDQSRNWLPGPCYRQQRVSKKPDQNNNSEFSWTGATKYHLNGRDSLVNPGPAMASHKDDDGKFFPQSGVLIFGKQGATGSDVAIEHVMITDEEEIRTTNPVATEQYGSVSTNLQAGNAQAATADVN

SEQ ID NO: 2456 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSQRSTAAYGGVN

SEQ ID NO: 2457 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQDSEKTNVDIEKVMITDEEEIRTTNPVATEQYGSVSTNLQAGNAQAATADVN

SEQ ID NO: 2458 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGSETTSRLRFSQAGASDIRDQSRNWLPGPCYRQQRVSKTSADNNNSNFSWTGATKYHLNGRDSLVNPGPAMASHRDDEDKFFPQSGVLIFGKEGGTKNDVAIDGVMITDEEEIRTTNPVATEQYGSVSTNLQAGNAQAATADVN

SEQ ID NO: 2459 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHSDDTDRFFPQSGVLIFGKQGSEKTNVDIEKVMITDEEEIRTTNPVATEQYGSVSTNLQAGNAQAATADVN

SEQ ID NO: 2460 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGTGKNNIAFEDVMITDEEEIRTTNPVATEQYGSVSTNLQAGNAQAATADVN

SEQ ID NO: 2461 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGLTTLSQLGFSQAGASDIRDQSRNWLPGPCYRQQRVSKQPSQNNNSNFSWTGATKYHLNGRDSLVNPGPAMASHEDDNGRFFPQSGVLIFGKQGSEKTNVDIEKVMITDEEEIRTTNPVATEQYGSVSTNLQAGNAQAATADVN

SEQ ID NO: 2462 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRADAAVHMVA

SEQ ID NO: 2463 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNASGTNADVGQVMITDEEEIRTTNPVATEQYGSVSTNLQAGNAQAATADVN

SEQ ID NO: 2464 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSEFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 2465 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPSGHTTQSRLLFSQAGASDIRDQSRNWLPGPCYRQQRVSKTSADNNNSEYSWTGATKYHLNGRDSLVNPGPAMASHKDDEEKFFPQSGVLIFGKESSDRNNVDIEQVMITDEEEIRTTNPVATEQYGSVSTNLQAGNAQAATADVN

SEQ ID NO: 2466 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTKTNSSLSFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2467 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLLFSQAGASDIRDQSRNWLPGPCYRQQRVSTKDDRNNNSDFSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 2468 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHRDDDEKFFPQSGVLIFGKQSAKAANAAIDEVMITDEEEIRTTNPVATEQYGSVSTNLQAGNAQAATADVN

SEQ ID NO: 2469 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQEATADVN

SEQ ID NO: 2470 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDDDRFFPQSGVLIFGKQSATTGDVDVDRVMITDEEEIRTTNPVATEQYGSVSTNLQAGNAQAATADVN

SEQ ID NO: 2471 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDKFFPQSGVLIFGKQGATTTNTDFEQVMITDEEEIRTTNPVATEQYGSVSTNLQAGNAQAATADVN

SEQ ID NO: 2472 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHVTQSRLLFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2473 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQSAKAANAAIDEVMITDEEEIRTTNPVATEQYGSVSTNLQAGNAQAATADVN

SEQ ID NO: 2474 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGSEKTNVDIEKVMITDEEEIRTTNPVATEQYGSVSTNLQRGNRQAATADVN

SEQ ID NO: 2475 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 2476 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2477 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDKRGQAAVGVVT

SEQ ID NO: 2478 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEGRFFPQSGVLIFGKEGAGKTNIAVDRVMITDEEEIRTTNPVATEQYGSVSTNLQAGNAQAATADVN

SEQ ID NO: 2479 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSTKDTDNNNSNFSWTGATKYHLNGRDSLVNPGPAMASHKDDDDRFFPQSGVLIFGKQDTGASDVAIGNVMITDEEEIRTTNPVATEQYGSVSTNLQAGNAQAATADVN

SEQ ID NO: 2480 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDEKFFPQSGVLIFGKEDAGKTNIDIGQVMITDEEEIRTTNPVATEQYGSVSTNLQAGNAQAATADVN

SEQ ID NO: 2481 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGLQTLSDLRFSQAGASDIRDQSRNWLPGPCYRQQRVSKQPAGNNNSEFSWTGATKYHLNGRDSLVNPGPAMASHGDDDEKFFPQSGVLIFGKQGSEKTNVDIEKVMITDEEEIRTTNPVATEQYGSVSTNLQAGNAQAATADVN

SEQ ID NO: 2482 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHGDDKDKFFPQSGVLIFGKENASGTNVDIGNVMITDEEEIRTTNPVATEQYGSVSTNLQAGNAQAATADVN

SEQ ID NO: 2483 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQGGTAGDIDIGGVMITDEEEIRTTNPVATEQYGSVSTNLQAGNAQAATADVN

SEQ ID NO: 2484 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDGRFFPQSGVLIFGKQGSEKTNVDIEKVMITDEEEIRTTNPVATEQYGSVSTNLQAGNAQAATADVN

SEQ ID NO: 2485 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSTTSNENNNSDFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 2486 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 2487 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGPLTMSALRFSQAGASDIRDQSRNWLPGPCYRQQRVSKTSADNNNSEYSWTGATKYHLNGRDSLVNPGPAMASHKDDEGKFFPQSGVLIFGKENAGKANVAVGGVMITDEEEIRTTNPVATEQYGSVSTNLQAGNAQAATADVN

SEQ ID NO: 2488 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNTGSKTLSRLKFSQAGASDIRDQSRNWLPGPCYRQQRVSKTPNDNNNSNFSWTGATTYHLNGRDSLVNPGPAMASHRDDNDKFFPQSGVLIFGKQDADGDNVDVDQVMITDEEEIRTTNPVATEQYGSVSTNLQAGNAQAATADVN

SEQ ID NO: 2489 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSEYSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 2490 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRRDGAAFGEVH

SEQ ID NO: 2491 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGDRGNAAISDVN

SEQ ID NO: 2492 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGITTKSRLQFSQAGASDIRDQSRNWLPGPCYRQQRVSKTDGENNNSDFSWTGATKYHLNGRDSLVNPGPAMASHKDDEEKFFPQSGVLIFGKEGAGAADADVDHVMITDEEEIRTTNPVATEQYGSVSTNLQAGNAQAATADVN

SEQ ID NO: 2493 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSVDNNNSNFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 2494 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKEDTATTNAEIEDVMITDEEEIRTTNPVATEQYGSVSTNLQAGNAQAATADVN

SEQ ID NO: 2495 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANSGRHTQSELKFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2496 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGRMTMSKLQFSQAGASDIRDQSRNWLPGPCYRQQRVSKTSTDNNNSDFSWTGATTYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 2497 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQQAQAAVAKVH

SEQ ID NO: 2498 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKKDSRNNNSDFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 2499 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNGGTVTKSPLRFSQAGASDIRDQSRNWLPGPCYRQQRVSKQSADNNNSDFSWTGATKYHLNGRDSLVNPGPAMASHRDDEDKFFPQSGVLIFGKQDTGKNNVAIERVMITDEEEIRTTNPVATEQYGSVSTNLQAGNAQAATADVN

SEQ ID NO: 2500 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKQDATATNADYEHVMITDEEEIRTTNPVATEQYGSVSTNLQAGNAQAATADVN

SEQ ID NO: 2501 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSDFSWTGATTYHLNGRDSLVNPGPAMASHKDDDDKFFPQSGVLIFGKQSGSKNNVAVEDVMITDEEEIRTTNPVATEQYGSVSTNLQAGNAQAATADVN

SEQ ID NO: 2502 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAQQAGAATNTVE

SEQ ID NO: 2503 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGIATQSRLKFSQAGASDIRDQSRNWLPGPCYRQQRVSKTSADNNNSEYSWTGATKYHLNGRDSLVNPGPAMASHRDDDEKFFPQSGVLIFGKQGAATADIEIDKVMITDEEEIRTTNPVATEQYGSVSTNLQAGNAQAATADVN

SEQ ID NO: 2504 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSTTPADNNNSDFSWTGATKYHLNGRDSLVNPGPAMASHKDDEDKFFPQSGVLIFGKQDAGKANIDIDGVMITDEEEIRTTNPVATEQYGSVSTNLQAGNAQAATADVN

SEQ ID NO: 2505 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNNSGSATNSRLRFSQAGASDIRDQSRNWLPGPCYRQQRVSKTSADNNNSEYSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 2506 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSTKPSDNNNSEFSWTGATKYHLNGRDSLVNPGPAMASHKDDEEKFFPQSGVLIFGKQNTGRSDADIESVMITDEEEIRTTNPVATEQYGSVSTNLQAGNAQAATADVN

SEQ ID NO: 2507 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSHGGIITKSHLRFSQAGASDIRDQSRNWLPGPCYRQQRVSKTDGENNNSDFSWTGATKYHLNGRDSLVNPGPAMASHKDDEEKFFPQSGVLIFGKESATGDNVEIGQVMITDEEEIRTTNPVATEQYGSVSTNLQAGNAQAATADVN

SEQ ID NO: 2508 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSVDNNNSNFSWTGATKYHLNGRDSLVNPGPAMASHKDDDDRFFPQSGVLIFGKEDAGKTNIDIGQVMITDEEEIRTTNPVATEQYGSVSTNLQAGNAQAATADVN

SEQ ID NO: 2509 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDRFFPQSGVLIFGKEGSGKANVEIGRVMITDEEEIRTTNPVATEQYGSVSTNLQAGNAQAATADVN

SEQ ID NO: 2510 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHRDDADKFFPQSGVLIFGKEDGKGNNVAFDEVMITDEEEIRTTNPVATEQYGSVSTNLQAGNAQAATADVN

SEQ ID NO: 2511 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2512 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTEKFFPQSGVLIFGKQGSEKTNVDIEKVMITDEEEIRTTNPVATEQYGSVSTNLQRGNRQAATADVN

SEQ ID NO: 2513 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNTRAGAAIGDVK

SEQ ID NO: 2514 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKEGAGANDVAVEHVMITDEEEIRTTNPVATEQYGSVSTNLQAGNAQAATADVN

SEQ ID NO: 2515 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTEKFFPQSGVLIFGKQGSEKTNVDIEKVMITDEEEIRTTNPVATEQYGSVSTNLQAGNAQAATADVN

SEQ ID NO: 2516 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDSEATNIAFEDVMITDEEEIRTTNPVATEQYGSVSTNLQAGNAQAATADVN

SEQ ID NO: 2517 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2518 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKEDAAGTNADVGSVMITDEEEIRTTNPVATEQYGSVSTNLQAGNAQAATADVN

SEQ ID NO: 2519 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDATGTLTISNLRFSQAGASDIRDQSRNWLPGPCYRQQRVSKKPDQNNNSDFSWTGATKYHLNGRDSLVNPGPAMASHRDDEGKFFPQSGVLIFGKEGGDGSNVDFERVMITDEEEIRTTNPVATEQYGSVSTNLQAGNAQAATADVN

SEQ ID NO: 2520 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTYNDNNNSEFSWTGATTYHLNGRDSLVNPGPAMASHKDDDERFFPQSGVLIFGKEGAGKTNIAVDRVMITDEEEIRTTNPVATEQYGSVSTNLQAGNAQAATADVN

SEQ ID NO: 2521 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGNPTMSELRFSQAGASDIRDQSRNWLPGPCYRQQRVSTQYTDNNNSNFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 2522 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTTPADNNNSDFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2523 - protein, 334 aa, Artificial Sequence
  Synthetic
NAGGTNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQASGNNNSNFSWTGATKYHLNGRDSLVNPGPAMASHKDDEDKFFPQSGVLIFGKEGASKTNIEYGQVMITDEEEIRTTNPVATEQYGSVSTNLQAGNAQAATADVN

SEQ ID NO: 2524 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGNNTTSSLHFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2525 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGRFFPQSGVLIFGKQNAGATDVAFDEVMITDEEEIRTTNPVATEQYGSVSTNLQAGNAQAATADVN

SEQ ID NO: 2526 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASGGSVTISSLRFSQAGASDIRDQSRNWLPGPCYRQQRVSKTSADNNNSEYSWTGATKYHLNGRDSLVNPGPAMASHKDDEEKFFPQSGVLIFGKQGAGKDDVDIGGVMITDEEEIRTTNPVATEQYGSVSTNLQAGNAQAATADVN

SEQ ID NO: 2527 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKKDDRNNNSDFSWTGATKYHLNGRDSLVNPGPAMASHKDDDDRFFPQSGVLIFGKESAKTADAAVDDVMITDEEEIRTTNPVATEQYGSVSTNLQAGNAQAATADVN

SEQ ID NO: 2528 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQDSGGGDAEVEQVMITDEEEIRTTNPVATEQYGSVSTNLQAGNAQAATADVN

SEQ ID NO: 2529 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGTVTHSHLVFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2530 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 2531 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKEDGSKTNAEIDRVMITDEEEIRTTNPVATEQYGSVSTNLQAGNAQAATADVN

SEQ ID NO: 2532 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPGGNNNSNFSWTGATKYHLNGRDSLVNPGPAMASHRDDEDKFFPQSGVLIFGKQGATEDNVAIDKVMITDEEEIRTTNPVATEQYGSVSTNLQAGNAQAATADVN

SEQ ID NO: 2533 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSEKTNVDIEKVMITDEEEIRTTNPVATEQYGSVSTNLQAGNAQAATADVN

SEQ ID NO: 2534 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNDGGIVTMSRLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2535 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGKSSNAAANGVN

SEQ ID NO: 2536 - protein, 334 aa, Artificial Sequence
  Synthetic
PTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSSGNNNSDFSWTGATKYHLNGRDSLVNPGPAMASHKDDDDKFFPQSGVLIFGKQGAKGDNADVESVMITDEEEIRTTNPVATEQYGSVSTNLQAGNAQAATADVN

SEQ ID NO: 2537 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGHMTLSGLRFSQAGASDIRDQSRNWLPGPCYRQQRVSKTSADNNNSEYSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 2538 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSAGKDNVAFDGVMITDEEEIRTTNPVATEQYGSVSTNLQAGNAQAATADVN

SEQ ID NO: 2539 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGHVTKSQLMFSQAGASDIRDQSRNWLPGPCYRQQRVSKTDGENNNSDFSWTGATKYHLNGRDSLVNPGPAMASHKDDEEKFFPQSGVLIFGKQGARGADAEIESVMITDEEEIRTTNPVATEQYGSVSTNLQAGNAQAATADVN

SEQ ID NO: 2540 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEGSKASNVAVDHVMITDEEEIRTTNPVATEQYGSVSTNLQAGNAQAATADVN

SEQ ID NO: 2541 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGHKTTSDLRFSQAGASDIRDQSRNWLPGPCYRQQRVSKTSADNNNSEFSWTGATKYHLNGRDSLVNPGPAMASHRDDADKFFPQSGVLIFGKESGEKNNIDIDGVMITDEEEIRTTNPVATEQYGSVSTNLQAGNAQAATADVN

SEQ ID NO: 2542 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGLHTTSRLRFSQAGASDIRDQSRNWLPGPCYRQQRVSKQSDDNNNSDFSWPGATKYHLNGRDSLVNPGPAMASHKDDNDKFFPQSGVLIFGKQGSEKTNVDIEKVMITDEEEIRTTNPVATEQYGSVSTNLQAGNAQAATADVN

SEQ ID NO: 2543 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSGKNNADIEKVMITDEEEIRTTNPVATEQYGSVSTNLQAGNAQAATADVN

SEQ ID NO: 2544 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSKTADHNNNSDFSWTGATKYHLNGRDSLVNPGPAMASHRDDEDKFFPQSGVLIFGKKNTTENNVDIDGVMITDEEEIRTTNPVATEQYGSVSTNLQAGNAQAATADVN

SEQ ID NO: 2545 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2546 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSTTPADNNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 2547 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSKTPAENNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 2548 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHGDDNDRFFPQSGVLIFGKQGSEKTNVDIEKVMITDEEEIRTTNPVATEQYGSVSTNLQAGNAQAATADVN

SEQ ID NO: 2549 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2550 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGHKTNSGLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 2551 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKEGAAANNVEIDGVMITDEEEIRTTNPVATEQYGSVSTNLQAGNAQAATADVN

SEQ ID NO: 2552 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNDNSEYSWTGATKYHLNGRDSLVNPGPAMASHEDDKDKFFPQSGVLIFGKQGSEKTNVDIEKVMITDEEEIRTTNPVATEQYGSVSTNLQRGNRQAATADVN

SEQ ID NO: 2553 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGHPTKSRLVFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2554 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAGKDDADIERVMITDEEEIRTTNPVATEQYGSVSTNLQAGNAQAATADVN

SEQ ID NO: 2555 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTASGNLTQSALNFSQAGASDIRDQSRNWLPGPCYRQQRVSKTSADNNNSEYSWTGATKYHLNGRDSLVNPGPAMASHGDDNDKFFPQSGVLIFGKQNGGGNNVDVDQVMITDEEEIRTTNPVATEQYGSVSTNLQAGNAQAATADVN

SEQ ID NO: 2556 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGHDTTSELRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2557 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRSGPNTTSALMFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAAQTSAAAQIVT

SEQ ID NO: 2558 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKEGSGKSDAAIGDVMITDEEEIRTTNPVATEQYGSVSTNLQAGNAQAATADVN

SEQ ID NO: 2559 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGHKTPSNLGFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2560 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKEGADRNNVDIGSVMITDEEEIRTTNPVATEQYGSVSTNLQAGNAQAATADVN

SEQ ID NO: 2561 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNKTHSALLFSQAGASDIRDQSRNWLPGPCYRQQRVSTTPADNNNSDFSWTGATKYHLNGRDSLVNPGPAMASHKDDDEKFFPQSGVLIFGKQNSAGANAEYDDVMITDEEEIRTTNPVATEQYGSVSTNLQAGNAQAATADVN

SEQ ID NO: 2562 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGANGANIEIGDVMITDEEEIRTTNPVATEQYGSVSTNLQAGNAQAATADVN

SEQ ID NO: 2563 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASGGSVTISSLRFSQAGASDIRDQSRNWLPGPCYRQQRVSKTSADNNNSNFSWTGATKYHLNGRDSLVNPGPAMASHRDDEDKFFPQSGVLIFGKEGTEKSNVAIERVMITDEEEIRTTNPVATEQYGSVSTNLQAGNAQAATADVN

SEQ ID NO: 2564 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSTQASHNNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2565 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRPRTAAASEGVN

SEQ ID NO: 2566 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAGGSETISGLQFSQAGASDIRDQSRNWLPGPCYRQQRVSKTSADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 2567 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKAGDNNNSNFSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 2568 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKATDNNNSNFSWTGATTYHLNGRDSLVNPGPAMASHKDDDEKFFPQSGVLIFGKQDAGANNAEVDHVMITDEEEIRTTNPVATEQYGSVSTNLQAGNAQAATADVK

SEQ ID NO: 2569 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2570 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2571 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQNTSGSDIDIDEVMITDEEEIRTTNPVATEQYGSVSTNLQAGNAQAATADVN

SEQ ID NO: 2572 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATKYHLNGRDSLVNPGPAMASHKDDDEKFFPQSGVLIFGKEDGGRGNVDVEDVMITDEEEIRTTNPVATEQYGSVSTNLQRGNRQAATADVN

SEQ ID NO: 2573 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRSGHETQSNLNFSQAGASDIRDQSRNWLPGPCYRQQRVSKVSADNNNSEFSWTGATKYHLNGRDSLVNPGPAMASHKDDEEKFFPQSGVLIFGKEGGSGSNVAVDKVMITDEEEIRTTNPVATEQYGSVSTNLQAGNAQAATADVN

SEQ ID NO: 2574 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGTGPMTKSDLRFSQAGASDIRDQSRNWLPGPCYRQQRVSKTSADNNNSEFSWTGATTYHLNGRDSLVNPGPAMASHRDDNEKFFPQSGVLIFGKQGSEKTNVDIEKVMITDEEEIRTTNPVATEQYGSVSTNLQAGNAQAATADVN

SEQ ID NO: 2575 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHEDDTGRFFPQSGVLIFGKQGSEKTNVDIEKVMITDEEEIRTTNPVATEQYGSVSTNLQAGNAQAATADVN

SEQ ID NO: 2576 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARRDPAAFANVE

SEQ ID NO: 2577 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNGQDTAAARSVA

SEQ ID NO: 2578 - protein, 334 aa, Artificial Sequence; identical to SEQ ID NO: 459
  Synthetic

SEQ ID NO: 2579 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKENGKTNDVAIEGVMITDEEEIRTTNPVATEQYGSVSTNLQAGNAQAATADVN

SEQ ID NO: 2580 - protein, 334 aa, Artificial Sequence
  Synthetic
KAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRAGSVTMSKLGFSQAGASDIRDQSRNWLPGPCYRQQRVSKTDGENNNSDFSWTGATKYHLNGRDSLVNPGPAMASHKDDEEKFFPQSGVLIFGKQDGGGSNVDIEGVMITDEEEIRTTNPVATEQYGSVSTNLQAGNAQAATADVN

SEQ ID NO: 2581 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRSNTAAYHVVN

SEQ ID NO: 2582 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDDKFFPQSGVLIFGKQNTRRGDIEIEDVMITDEEEIRTTNPVATEQYGSVSTNLQAGNAQAATADVN

SEQ ID NO: 2583 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESGAAANVEVEQVMITDEEEIRTTNPVATEQYGSVSTNLQAGNAQAATADVN

SEQ ID NO: 2584 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGAGTNDIDIERVMITDEEEIRTTNPVATEQYGSVSTNLQAGNAQAATADVN

SEQ ID NO: 2585 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAKGGPTTHSPLRFSQAGASDIRDQSRNWLPGPCYRQQRVSKKDDGNNNSNFSWTGATTYHLNGRDSLVNPGPAMASHRDDEDRFFPQSGVLIFGKEGSGANDIDIGSVMITDEEEIRTTNPVATEQYGSVSTNLQAGNAQAATADVN

SEQ ID NO: 2586 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATKYHLNGRDSLVNPGPAMASHKDDNDRFFPQSGVLIFGKEDSRKSNADIEGVMITDEEEIRTTNPVATEQYGSVSTNLQAGNAQAATADVN

SEQ ID NO: 2587 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATTYHLNGRDSLVNPGPAMASHRDDTGKFFPQSGVLIFGKQGSEKTNVDIEKVMITDEEEIRTTNPVATEQYGSVSTNLQAGNAQAATADVN

SEQ ID NO: 2588 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2589 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGRVTPSRLGFSQAGASDIRDQSRNWLPGPCYRQQRVSKTSADNNNSEYSWTGATKYHLNGRDSLVNPGPAMASHKDDDDRFFPQSGVLIFGKQGASTTNAAIEDVMITDEEEIRTTNPVATEQYGSVSTNLQAGNAQAATADVN

SEQ ID NO: 2590 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNERFFPQSGVLIFGKEGAAAANVAFESVMITDEEEIRTTNPVATEQYGSVSTNLQAGNAQAATADVN

SEQ ID NO: 2591 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRKDRAADKIVD

SEQ ID NO: 2592 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 2593 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGSMTNSGLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2594 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDRFFPQSGVLIFGKEDTSATNADYDGVMITDEEEIRTTNPVATEQYGSVSTNLQAGNAQAATADVN

SEQ ID NO: 2595 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 2596 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGRLTTSPLGFSQAGASDIRDQSRNWLPGPCYRQQRVSTTPADNNNSEFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 2597 - protein, 334 aa, Artificial Sequence; identical to SEQ ID NO: 358
  Synthetic

SEQ ID NO: 2598 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKESSTTGNVAIEGVMITDEEEIRTTNPVATEQYGSVSTNLQAGNAQAATADVN

SEQ ID NO: 2599 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDANTNNADVDSVMITDEEEIRTTNPVATEQYGSVSTNLQAGNAQAATADVN

SEQ ID NO: 2600 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKEDSGAGNVAVEGVMITDEEEIRTTNPVATEQYGSVSTNLQAGNAQAATADVN

SEQ ID NO: 2601 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKEDAGKSDVEIEHVMITDEEEIRTTNPVATEQYGSVSTNLQAGNAQAATADVN

SEQ ID NO: 2602 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASGGSITTSRLRFSQAGASDIRDQSRNWLPGPCYRQQRVSKTYNDNNNSEFSWTGATTYHLNGRDSLVNPGPAMASHKDDEEKFFPQSGVLIFGKEDSGKNNVDIGGVMITDEEEIRTTNPVATEQYGSVSTNLQAGNAQAATADVN

SEQ ID NO: 2603 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATAGTVTHSRLRFSQAGASDIRDQSRNWLPGPCYRQQRVSKQASDNNNSEFSWTGATKYHLNGRDSLVNPGPAMASHKDDEEKFFPQSGVLIFGKQSGDETDVEIDRVMITDEEEIRTTNPVATEQYGSVSTNLQAGNAQAATADVN

SEQ ID NO: 2604 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2605 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKEGTGRANVAIEGVMITDEEEIRTTNPVATEQYGSVSTNLQAGNAQAATADVN

SEQ ID NO: 2606 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQDGDTNNIDVERVMITDEEEIRTTNPVATEQYGSVSTNLQAGNAQAATADVN

SEQ ID NO: 2607 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAGGTLTHSRLKFSQAGASDIRDQSRNWLPGPCYRQQRVSKVSADNNNSEFSWTGATKYHLNGRDSLVNPGPAMASHKDDEEKFFPQSGVLIFGKESSGKADVEFGEVMITDEEEIRTTNPVATEQYGSVSTNLQAGNAQAATADVN

SEQ ID NO: 2608 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2609 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTNTQSGLRFSQAGASDIRDQSRNWLPGPCYRQQRVSKQSDHNNNSNFSWTGATKYHLNGRDSLVNPGPAMASHKDDDDKFFPQSGVLIFGKQNAAKANVDIGDVMITDEEEIRTTNPVATEQYGSVSTNLQAGNAQAATADVN

SEQ ID NO: 2610 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTDGENNNSDFSWTGATKYHLNGRDSLVNPGPAMASHKDDEEKFFPQSGVLIFGKQGTKRDDVAIDEVMITDEEEIRTTNPVATEQYGSVSTNLQAGNAQAATADVN

SEQ ID NO: 2611 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGGFFPQSGVLIFGKQGAGKNNAAIGQVMITDEEEIRTTNPVATEQYGSVSTNLQAGNAQAATADVN

SEQ ID NO: 2612 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYHLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 2613 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDERFFPQSGVLIFGKQGATESDVDFDQVMITDEEEIRTTNPVATEQYGSVSTNLQAGNAQAATADVN

SEQ ID NO: 2614 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2615 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHAGSKTTSELKFSQAGASDIRDQSRNWLPGPCYRQQRVSKKYTDNNNSNFSWTGATTYHLNGRDSLVNPGPAMASHKDDEEKFFPQSGVLIFGKQGAGANNVDFGEVMITDEEEIRTTNPVATEQYGSVSTNLQAGNAQAATADVN

SEQ ID NO: 2616 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQDGHNNNSDFSWTGATTYHLNGRDSLVNPGPAMASHEDDAGRFFPQSGVLIFGKQGAGKDDIAIDNVMITDEEEIRTTNPVATEQYGSVSTNLQAGNAQAATADVN

SEQ ID NO: 2617 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 2618 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKTDDDNNNSDFSWTGATKYHLNGRDSLVNPGPAMASHRDDEDKFFPQSGVLIFGKQNGRGTDVEIDGVMITDEEEIRTTNPVATEQYGSVSTNLQAGNAQAATADVN

SEQ ID NO: 2619 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTGTTNVEVGQVMITDEEEIRTTNPVATEQYGSVSTNLQAGNAQAATADVN

SEQ ID NO: 2620 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGSMTPSGLVFSQAGASDIRDQSRNWLPGPCYRQQRVSTTPADNNNSDFSWTGATKYHLNGRDSLVNPGPAMASHKDDDEKFFPQSGVLIFGKEDAGTTNVAFDKVMITDEEEIRTTNPVATEQYGSVSTNLQAGNAQAATADVN

SEQ ID NO: 2621 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGTTTKSGLRFSQAGASDIRDQSRNWLPGPCYRQQRVSTQPTENNNSDFSWTGATKYHLNGRDSLVNPGPAMASHKDDEEKFFPQSGVLIFGKQGATRSDVDYGHVMITDEEEIRTTNPVATEQYGSVSTNLQAGNAQAATADVN

SEQ ID NO: 2622 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTQPARNNNSNFSWTGATTYHLNGRDSLVNPGPAMASHGDDDDKFFPQSGVLIFGKQGSEKTNVDIEKVMITDEEEIRTTNPVATEQYGSVSTNLQAGNAQAATADVN

SEQ ID NO: 2623 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGSHTQSALRFSQAGASDIRDQSRNWLPGPCYRQQRVSTQASGNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2624 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKEDAGRNNVDVENVMITDEEEIRTTNPVATEQYGSVSTNLQAGNAQAATADVN

SEQ ID NO: 2625 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDDRFFPQSGVLIFGKEGAGRDDVDVEEVMITDEEEIRTTNPVATEQYGSVSTNLQAGNAQAATADVN

SEQ ID NO: 2626 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNATGTNVDVGSVMITDEEEIRTTNPVATEQYGSVSTNLQAGNAQAATADVN

SEQ ID NO: 2627 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 2628 - protein, 334 aa, Artificial Sequence
  Synthetic
KAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSKQASDNNNSNFSWTGATTYHLNGRDSLVNPGPAMASHKDDEGRFFPQSGVLIFGKQGSEKTNVDIEKVMITDEEEIRTTNPVATEQYGSVSTNLQRGNRQAATADVN

SEQ ID NO: 2629 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKEDASGTNVDFDRVMITDEEEIRTTNPVATEQYGSVSTNLQAGNAQAATADVN

SEQ ID NO: 2630 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 2631 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSGRNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2632 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQDASGSNVDIGRVMITDEEEIRTTNPVATEQYGSVSTNLQAGNAQAATADVN

SEQ ID NO: 2633 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRQAGAAIQEVN

SEQ ID NO: 2634 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKAGSETNSRLLFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2635 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTSSGNPTNSQLKFSQAGASDIRDQSRNWLPGPCYRQQRVSKQPNDNNNSEFSWTGATTYHLNGRDSLVNPGPAMASHKDDNEKFFPQSGVLIFGKQGAGGADIEFDQVMITDEEEIRTTNPVATEQYGSVSTNLQAGNAQAATADVN

SEQ ID NO: 2636 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAGGLKTLSRLGFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2637 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDDEKFFPQSGVLIFGKQGAEATDVAFDSVMITDEEEIRTTNPVATEQYGSVSTNLQAGNAQAATADVN

SEQ ID NO: 2638 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQDTDNNNSDFSWTGATKYHLNGRDSLVNPGPAMASHGDDTEKFFPQSGVLIFGKEGAGANDVAYENVMITDEEEIRTTNPVATEQYGSVSTNLQAGNAQAATADVN

SEQ ID NO: 2639 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTHNNNSDFSWTGATKYHLNGRDSLVNPGPAMASHKDDEDKFFPQSGVLIFGKENSGTNNAEIDNVMITDEEEIRTTNPVATEQYGSVSTNLQAGNAQAATADVN

SEQ ID NO: 2640 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2641 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 2642 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNQTQSPLKFSQAGASDIRDQSRNWLPGPCYRQQRVSTKSNENNNSNFSWTGATKYHLNGRDSLVNPGPAMASHKDDEGRFFPQSGVLIFGKEDGGKSNVEIDRVMITDEEEIRTTNPVATEQYGSVSTNLQAGNAQAATADVN

SEQ ID NO: 2643 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPRTTAATNAVT

SEQ ID NO: 2644 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKQPNDNNNSEFSWTGATTYHLNGRDSLVNPGPAMASHKDDNEKFFPQSGVLIFGKQDSTAGNVEIEEVMITDEEEIRTTNPVATEQYGSVSTNLQAGNAQAATADVN

SEQ ID NO: 2645 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDTGTLTQSKLKFSQAGASDIRDQSRNWLPGPCYRQQRVSTQASGNNNSEFSWTGATKYHLNGRDSLVNPGPAMASHKDDEEKFFPQSGVLIFGKQSARGTNADIDEVMITDEEEIRTTNPVATEQYGSVSTNLQAGNAQAATADVN

SEQ ID NO: 2646 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKENSGGSNIEVGGVMITDEEEIRTTNPVATEQYGSVSTNLQAGNAQAATADVN

SEQ ID NO: 2647 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNEKFFPQSGVLIFGKEGSEKTNVDIEKVMITDEEEIRTTNPVATEQYGSVSTNLQAGNAQAATADVN

SEQ ID NO: 2648 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAAGNKTLSGLLFSQAGASDIRDQSRNWLPGPCYRQQRVSTKSNENNNSNFSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 2649 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGPITLSALRFSQAGASDIRDQSRNWLPGPCYRQQRVSTQPTDNNNSEFSWTGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 2650 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHGDDTGKFFPQSGVLIFGKQGSEKTNVDIEKVMITDEEEIRTTNPVATEQYGSVSTNLQRGNRQAATADVN

SEQ ID NO: 2651 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDAGKFFPQSGVLIFGKQGSEKTNVDIEKVMITDEEEIRTTNPVATEQYGSVSTNLQRGNRQAATADVN

SEQ ID NO: 2652 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGSVTQSHLRFSQAGASDIRDQSRNWLPGPCYRQQRVSKQSSDNNNSEFSWTGATKYHLNGRDSLVNPGPAMASHKDDAEKFFPQSGVLIFGKENAGKSDVEIEHVMITDEEEIRTTNPVATEQYGSVSTNLQAGNAQAATADVN

SEQ ID NO: 2653 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNSRTQAAFQSVQ

SEQ ID NO: 2654 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKENSGKANVDIEQVMITDEEEIRTTNPVATEQYGSVSTNLQAGNAQAATADVN

SEQ ID NO: 2655 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWPGATKYHLNGRDSLVNPGPAMASHRDDDDKFFPQSGVLIFGKQDGTTANADVDQVMITDEEEIRTTNPVATEQYGSVSTNLQAGNAQAATADVN

SEQ ID NO: 2656 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKQGATRSNIDIGNVMITDEEEIRTTNPVATEQYGSVSTNLQAGNAQAATADVN

SEQ ID NO: 2657 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAGKTDVDYGEVMITDEEEIRTTNPVATEQYGSVSTNLQRGNRQAATADVN

SEQ ID NO: 2658 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGAGGNNVDFGEVMITDEEEIRTTNPVATEQYGSVSTNLQAGNAQAATADVN

SEQ ID NO: 2659 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGPATKSALGFSQAGASDIRDQSRNWLPGPCYRQQRVSKTSADNNNSEYSWTGATKYHLNGRDSLVNPGPAMASHKDDEEKFFPQSGVLIFGKEGAGGTDIDIGHVMITDEEEIRTTNPVATEQYGSVSTNLQAGNAQAATADVN

SEQ ID NO: 2660 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQGSRRNDVDIDRVMITDEEEIRTTNPVATEQYGSVSTNLQAGNAQAATADVN

SEQ ID NO: 2661 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSSRGPAAFTGVD

SEQ ID NO: 2662 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGPVTPSNLRFSQAGASDIRDQSRNWLPGPCYRQQRVSKQSDRNNNSEFSWTGATKYHLNGRDSLVNPGPAMASHKDDDEKFFPQSGVLIFGKEGTGRNDVAIEEVMITDEEEIRTTNPVATEQYGSVSTNLQAGNAQAATADVN

SEQ ID NO: 2663 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKESSTTGNIEIDRVMITDEEEIRTTNPVATEQYGSVSTNLQAGNAQAATADVN

SEQ ID NO: 2664 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSTAESNIDIDGVMITDEEEIRTTNPVATEQYGSVSTNLQAGNAQAATADVN

SEQ ID NO: 2665 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSARTGAASNTVD

SEQ ID NO: 2666 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTSADNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 2667 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATKYHLNGRDSLVNPGPAMASHEDDNDRFFPQSGVLIFGKQGSEKTNVDIEKVMITDEEEIRTTNPVATEQYGSVSTNLQAGNAQAATADVN

SEQ ID NO: 2668 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDEDKFFPQSGVLIFGKESSNRDNVDIGQVMITDEEEIRTTNPVATEQYGSVSTNLQAGNAQAATADVN

SEQ ID NO: 2669 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDSKAGAATRGVN

SEQ ID NO: 2670 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTHTRNNNSDFSWTGATTYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2671 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSNENNNSDFSWTGATTYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 2672 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKTGITTNSRLSFSQAGASDIRDQSRNWLPGPCYRQQRVSKTDGENNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2673 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGQRSHAADRNVE

SEQ ID NO: 2674 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEDGKGANVDIGEVMITDEEEIRTTNPVATEQYGSVSTNLQAGNAQAATADVN

SEQ ID NO: 2675 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQDAAGANIEIGNVMITDEEEIRTTNPVATEQYGSVSTNLQAGNAQAATADVN

SEQ ID NO: 2676 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKVSADNNNSEFSWTGATKYHLNGRDSLVNPGPAMASHKDDEEKFFPQSGVLIFGKQNATEGDIDIGGVMITDEEEIRTTNPVATEQYGSVSTNLQAGNAQAATADVN

SEQ ID NO: 2677 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 2678 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTGNNNSNFSWTGATTYHLNGRDSLVNPGPAMASHKDDEEKFFPQSGVLIFGKQDTAAANVDVGEVMITDEEEIRTTNPVATEQYGSVSTNLQAGNAQAATADVN

SEQ ID NO: 2679 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQASGNNNSEFSWTGATKYHLNGRDSLVNPGPAMASHRDDDDRFFPQSGVLIFGKEGSKKGDADIESVMITDEEEIRTTNPVATEQYGSVSTNLQAGNAQAATADVN

SEQ ID NO: 2680 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKAGSTTLSELRFSQAGASDIRDQSRNWLPGPCYRQQRVSKQPTGNNNSDFSWTGATKYHLNGRDSLVNPGPAMASHRDDEEKFFPQSGVLIFGKEGTEKSNVDIERVMITDEEEIRTTNPVATEQYGSVSTNLQAGNAQAATADVN

SEQ ID NO: 2681 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEGRFFPQSGVLIFGKESAGADNVAYEKVMITDEEEIRTTNPVATEQYGSVSTNLQAGNAQAATADVN

SEQ ID NO: 2682 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQTQRSPAASADVT

SEQ ID NO: 2683 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSTQSTGNNNSNFSWTGATKYHLNGRDSLVNPGPAMASHKDDEEKFFPQSGVLIFGKEGAAESDVAIEQVMITDEEEIRTTNPVATEQYGSVSTNLQAGNAQAATADVN

SEQ ID NO: 2684 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTSKDAAAIATVA

SEQ ID NO: 2685 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 2686 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNSSGLVTISSLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2687 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2688 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTKAAAASQDVP

SEQ ID NO: 2689 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARSDGAAAGAVN

SEQ ID NO: 2690 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2691 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNTGSKTLSRLKFSQAGASDIRDQSRNWLPGPCYRQQRVSKTDGENNNSDFSWTGATKYHLNGRDSLVNPGPAMASHKDDEEKFFPQSGVLIFGKEGAAGDNIDVERVMITDEEEIRTTNPVATEQYGSVSTNLQAGNAQAATADVN

SEQ ID NO: 2692 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHRDDTGRFFPQSGVLIFGKQSASKADAEIGSVMITDEEEIRTTNPVATEQYGSVSTNLQAGNAQAATADVN

SEQ ID NO: 2693 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDDRNNNSDFSWTGATKYHLNGRDSLVNPGPAMASHKDDDDRFFPQSGVLIFGKESAKTADAAVDDVMITDEEEIRTTNPVATEQYGSVSTNLQRGNRQAATADVN

SEQ ID NO: 2694 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGNPTMSELRFSQAGASDIRDQSRNWLPGPCYRQQRVSTQYDRNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2695 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQTGRNTTSDLRFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2696 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKESSGAANVAVDGVMITDEEEIRTTNPVATEQYGSVSTNLQAGNAQAATADVN

SEQ ID NO: 2697 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTHSSLVFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2698 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRTGTATQSTLNFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2699 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRDHSPAAFHEVA

SEQ ID NO: 2700 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGTLTTSNLRFSQAGASDIRDQSRNWLPGPCYRQQRVSKKASDNNNSDFSWTGATKYHLNGRDSLVNPGPAMASHEDDNDKFFPQSGVLIFGKEGTGRANVAIEGVMITDEEEIRTTNPVATEQYGSVSTNLQAGNAQAATADVN

SEQ ID NO: 2701 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARNPAATGNVA

SEQ ID NO: 2702 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQRGNRQAATADVN

SEQ ID NO: 2703 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNATGLVTTSHLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2704 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKEGAAKSDVAVGGVMITDEEEIRTTNPVATEQYGSVSTNLQAGNAQAATADVN

SEQ ID NO: 2705 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 2706 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHRDDAEKFFPQSGVLIFGKQDAGGNNIAYESVMITDEEEIRTTNPVATEQYGSVSTNLQAGNAQAATADVN

SEQ ID NO: 2707 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGHAGSKTTSELKFSQAGASDIRDQSRNWLPGPCYRQQRVSTTPTGNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2708 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQRGEAAATAVH

SEQ ID NO: 2709 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKQASDNNNSEFSWTGATKYHLNGRDSLVNPGPAMASHRDDNEKFFPQSGVLIFGKQGSEKTNVDIEKVMITDEEEIRTTNPVATEQYGSVSTNLQAGNAQAATADVN

SEQ ID NO: 2710 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQDARGNNVEIDQVMITDEEEIRTTNPVATEQYGSVSTNLQAGNAQAATADVN

SEQ ID NO: 2711 - protein, 334 aa, Artificial Sequence; identical to SEQ ID NO: 346
  Synthetic

SEQ ID NO: 2712 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDDDKFFPQSGVLIFGKQGSEKTNVDIEKVMITDEEEIRTTNPVATEQYGSVSTNLQRGNRQAATADVN

SEQ ID NO: 2713 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGSNATNVDYDRVMITDEEEIRTTNPVATEQYGSVSTNLQAGNAQAATADVN

SEQ ID NO: 2714 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSKTADHNNNSDFSWTGATKYHLNGRDSLVNPGPAMASHRDDEDKFFPQSGVLIFGKKNTTENNVDIDGVMITDEEEIRTTNPVATEQYGSVSTNLQAGNAQAATADVN

SEQ ID NO: 2715 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNNTTSGLQFSQAGASDIRDQSRNWLPGPCYRQQRVSKTSDGNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2716 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTDKFFPQSGVLIFGKQGSEKTNVDIEKVMITDEEEIRTTNPVATEQYGSVSTNLQAGNAQAATADVN

SEQ ID NO: 2717 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTAGNTTQSELRFSQAGASDIRDQSRNWLPGPCYRQQRVSTTPADNNNSDFSWTGATKYHLNGRDSLVNPGPAMASHKDDDDRFFPQSGVLIFGKQGGGGSNVAIDGVMITDEEEIRTTNPVATEQYGSVSTNLQRGNRQAATADVN

SEQ ID NO: 2718 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATRDVH

SEQ ID NO: 2719 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSKQPAGNNNSDFSWTGATKYHLNGRDSLVNPGPAMASHKDDEEKFFPQSGVLIFGKQGAEATDVAFDSVMITDEEEIRTTNPVATEQYGSVSTNLQAGNAQAATADVN

SEQ ID NO: 2720 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRQSTAASDEVA

SEQ ID NO: 2721 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRAGINTMSKLLFSQAGASDIRDQSRNWLPGPCYRQQRVSKQSSDNNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2722 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTRGPAASKAVE

SEQ ID NO: 2723 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNRNNAAIAVVT

SEQ ID NO: 2724 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSKQANHNNNSEFSWTGATTYHLNGRDSLVNPGPAMASHKDDDDRFFPQSGVLIFGKQSGKTADAEVGDVMITDEEEIRTTNPVATEQYGSVSTNLQAGNAQAATADVN

SEQ ID NO: 2725 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQAGRKTPSPLLFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2726 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPHTHAANTDVP

SEQ ID NO: 2727 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDADGSNVAFEQVMITDEEEIRTTNPVATEQYGSVSTNLQAGNAQAATADVN

SEQ ID NO: 2728 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDHNNNSNFSWTGATKYHLNGRDSLVNPGPAMASHKDDDDKFFPQSGVLIFGKQNAGKNDTDIDGVMITDEEEIRTTNPVATEQYGSVSTNLQAGNAQAATADVN

SEQ ID NO: 2729 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKESAGRNDIAIDQVMITDEEEIRTTNPVATEQYGSVSTNLQAGNAQAATADVN

SEQ ID NO: 2730 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQTQRSGAAITDVE

SEQ ID NO: 2731 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDRFFPQSGVLIFGKQGSEKTNVDIEKVMITDEEEIRTTNPVATEQYGSVSTNLQAGNAQAATADVN

SEQ ID NO: 2732 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDEKFFPQSGVLIFGKQSGTKGDVAVGEVMITDEEEIRTTNPVATEQYGSVSTNLQAGNAQAATADVN

SEQ ID NO: 2733 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHRDDEGKFFPQSGVLIFGKQGGAENNVEFERVMITDEEEIRTTNPVATEQYGSVSTNLQAGNAQAATADVN

SEQ ID NO: 2734 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWPGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 2735 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGANKANVAVEGVMITDEEEIRTTNPVATEQYGSVSTNLQAGNAQAATADVN

SEQ ID NO: 2736 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDGGRATQSRLVFSQAGASDIRDQSRNWLPGPCYRQQRVSKTDGENNNSDFSWTGATTYHLNGRDSLVNPGPAMASHGDDADKFFPQSGVLIFGKQGSEKTNVDIEKVMITDEEEIRTTNPVATEQYGSVSTNLQAGNAQAATADVN

SEQ ID NO: 2737 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDTGRFFPQSGVLIFGKQGSEKTNADYDQVMITDEEEIRTTNPVATEQYGSVSTNLQAGNAQAATADVN

SEQ ID NO: 2738 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKEGTRKNNVDIEQVMITDEEEIRTTNPVATEQYGSVSTNLQAGNAQAATADVN

SEQ ID NO: 2739 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKENGARTNVDIEKVMITDEEEIRTTNPVATEQYGSVSTNLQAGNAQAATADVN

SEQ ID NO: 2740 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEGGRGANVAVEEVMITDEEEIRTTNPVATEQYGSVSTNLQAGNAQAATADVN

SEQ ID NO: 2741 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKQASDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2742 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 2743 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQSGSKNDIAIEDVMITDEEEIRTTNPVATEQYGSVSTNLQAGNAQAATADVN

SEQ ID NO: 2744 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 2745 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTGTTNVEVGQVMITDEEEIRTTNPVATEQYGSVSTNLQAGNAQAATADVN

SEQ ID NO: 2746 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDAGTTNAAIEHVMITDEEEIRTTNPVATEQYGSVSTNLQAGNAQAATADVN

SEQ ID NO: 2747 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDGGTTTKSQLRFSQAGASDIRDQSRNWLPGPCYRQQRVSKQPAGNNNSEFSWTGATKYHLNGRDSLVNPGPAMASHRDDNGKFFPQSGVLIFGKEGSGKSNTDFDSVMITDEEEIRTTNPVATEQYGSVSTNLQAGNAQAATADVN

SEQ ID NO: 2748 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSNFSWTGATTYHLNGRDSLVNPGPAMASHGDDNEKFFPQSGVLIFGKEGAAGSDVDIEKVMITDEEEIRTTNPVATEQYGSVSTNLQAGNAQAATADVN

SEQ ID NO: 2749 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHRDDDEKFFPQSGVLIFGKQDSEKTNVDIEKVMITDEEEIRTTNPVATEQYGSVSTNLQAGNAQAATADVN

SEQ ID NO: 2750 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDEKFFPQSGVLIFGKQDASGSNVDIGGVMITDEEEIRTTNPVATEQYGSVSTNLQAGNAQAATADVN

SEQ ID NO: 2751 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPRSPAAYANVT

SEQ ID NO: 2752 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDAKGDNADFEDVMITDEEEIRTTNPVATEQYGSVSTNLQAGNAQAATADVN

SEQ ID NO: 2753 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2754 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKKYTDNNNSNFSWTGATTYHLNGRDSLVNPGPAMASHRDDEDKFFPQSGVLIFGKEGGAGSDVEIDKVMITDEEEIRTTNPVATEQYGSVSTNLQAGNAQAATADVN

SEQ ID NO: 2755 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKGGSHTHSGLQFSQAGASDIRDQSRNWLPGPCYRQQRVSKQSSDNNNSEFSWTGATKYHLNGRDSLVNPGPAMASHKDDDDRFFPQSGVLIFGKQNTGGGNVDIDGVMITDEEEIRTTNPVATEQYGSVSTNLQAGNAQAATADVN

SEQ ID NO: 2756 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGRFFPQSGVLIFGKQNSNRNNVDIEGVMITDEEEIRTTNPVATEQYGSVSTNLQAGNAQAATADVN

SEQ ID NO: 2757 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARDGAAVRGVE

SEQ ID NO: 2758 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2759 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2760 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 2761 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGHNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2762 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSQRSTAAYGGVN

SEQ ID NO: 2763 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKEGTGRANVAIEGVMITDEEEIRTTNPVATEQYGSVSTNLQAGNAQAATADVN

SEQ ID NO: 2764 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDAKGTNIDFDGVMITDEEEIRTTNPVATEQYGSVSTNLQAGNAQAATADVN

SEQ ID NO: 2765 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPTGNNNSNFSWTGATKYHLNGRDSLVNPGPAMASHKDDEEKFFPQSGVLIFGKQSAGRGDAAVDEVMITDEEEIRTTNPVATEQYGSVSTNLQAGNAQAATADVN

SEQ ID NO: 2766 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGATRANVAIDEVMITDEEEIRTTNPVATEQYGSVSTNLQAGNAQAATADVN

SEQ ID NO: 2767 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGSHTTSALRFSQAGASDIRDQSRNWLPGPCYRQQRVSTTPADNNNSDFSWTGATKYHLNGRDSLVNPGPAMASHKDDDDRFFPQSGVLIFGKEDGAATDAAIDEVMITDEEEIRTTNPVATEQYGSVSTNLQAGNAQAATADVN

SEQ ID NO: 2768 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSGGNMTHSALRFSQAGASDIRDQSRNWLPGPCYRQQRVSKTHGDNNNSNFSWTGATTYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 2769 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQGGIATQSRLKFSQAGASDIRDQSRNWLPGPCYRQQRVSKTSADNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2770 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEGGNGSNVDIGRVMITDEEEIRTTNPVATEQYGSVSTNLQAGNAQAATADVN

SEQ ID NO: 2771 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 2772 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSEFSWTGATTYHLNGRDSLVNPGPAMASHRDDDEKFFPQSGVLIFGKQNSTATDIDVDGVMITDEEEIRTTNPVATEQYGSVSTNLQAGNAQAATADVN

SEQ ID NO: 2773 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSDFSWTGATKYHLNGRDSLVNPGPAMASHKDDNGRFFPQSGVLIFGKQSAKAANAAIDEVMITDEEEIRTTNPVATEQYGSVSTNLQAGNAQAATADVN

SEQ ID NO: 2774 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2775 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGRVTTSRLLFSQAGASDIRDQSRNWLPGPCYRQQRVSKVSADNNNSEFSWTGATKYHLNGRDSLVNPGPAMASHKDDEEKFFPQSGVLIFGKESAGAANVDIGEVMITDEEEIRTTNPVATEQYGSVSTNLQAGNAQAATADVN

SEQ ID NO: 2776 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKEGSRRANVAVEDVMITDEEEIRTTNPVATEQYGSVSTNLQAGNAQAATADVN

SEQ ID NO: 2777 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDASKTNVAIGQVMITDEEEIRTTNPVATEQYGSVSTNLQAGNAQAATADVN

SEQ ID NO: 2778 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAKTDNVDIGRVMITDEEEIRTTNPVATEQYGSVSTNLQAGNAQAATADVN

SEQ ID NO: 2779 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHRDDDDKFFPQSGVLIFGKEGAGTDDVEVDEVMITDEEEIRTTNPVATEQYGSVSTNLQAGNAQAATADVN

SEQ ID NO: 2780 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGLDTTSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2781 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNAGGLLTTSHLMFSQAGASDIRDQSRNWLPGPCYRQQRVSKTSADNNNSEYSWTGATKYHLNGRDSLVNPGPAMASHKDDEEKFFPQSGVLIFGKEGAGKSNVEIDNVMITDEEEIRTTNPVATEQYGSVSTNLQAGNAQAATAYVN

SEQ ID NO: 2782 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 2783 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKEGAGANDVAVEHVMITDEEEIRTTNPVATEQYGSVSTNLQAGNAQAATADVN

SEQ ID NO: 2784 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 2785 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTQRAGAAFNSVE

SEQ ID NO: 2786 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNATGIMTTSHLRFSQAGASDIRDQSRNWLPGPCYRQQRVSTTPADNNNSDFSWTGATKYHLNGRDSLVNPGPAMASHKDDDERFFPQSGVLIFGKQGSEKTNVDIEKVMITDEEEIRTTNPVATEQYGSVSTNLQRGNRQAATADVN

SEQ ID NO: 2787 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 2788 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNERFFPQSGVLIFGKQGAGKNNAAIGQVMITDEEEIRTTNPVATEQYGSVSTNLQAGNAQAATADVN

SEQ ID NO: 2789 - protein, 334 aa, Artificial Sequence; identical to SEQ ID NO: 193
  Synthetic

SEQ ID NO: 2790 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHNTHSRLGFSQAGASDIRDQSRNWLPGPCYRQQRVSTQASGNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2791 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDTERFFPQSGVLIFGKQGSEKTNVDIEKVMITDEEEIRTTNPVATEQYGSVSTNLQAGNAQAATADVN

SEQ ID NO: 2792 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDNHNNNSNFSWTGATKYHLNGRDSLVNPGPAMASHKDDDEKFFPQSGVLIFGKQNGGTGNVAIDRVMITDEEEIRTTNPVATEQYGSVSTNLQAGNAQAATADVN

SEQ ID NO: 2793 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2794 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGTATLSELKFSQAGASDIRDQSRNWLPGPCYRQQRVSKTPAGNNNSDFSWTGATKYHLNGRDSLVNPGPAMASHKDDDEKFFPQSGVLIFGKQNSAKSDVDIEGVMITDEEEIRTTNPVATEQYGSVSTNLQAGNAQAATADVN

SEQ ID NO: 2795 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 2796 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGNDTKSPLKFSQAGASDIRDQSRNWLPGPCYRQQRVSKQPNDNNNSEFSWTGATTYHLNGRDSLVNPGPAMASHKDDNEKFFPQSGVLIFGKQSASKNNIAIEEVMITDEEEIRTTNPVATEQYGSVSTNLQAGNAQAATADVN

SEQ ID NO: 2797 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRSSTAADTGVD

SEQ ID NO: 2798 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNQNNNSEFSWTGATTYHLNGRDSLVNPGPAMASHEDDNGRFFPQSGVLIFGKQGSEKTNVDIEKVMITDEEEIRTTNPVATEQYGSVSTNLQAGNAQAATADVN

SEQ ID NO: 2799 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQGARNAAAAEGVE

SEQ ID NO: 2800 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKPHDDNNNSDFSWTGATTYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 2801 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTQGGNQTQSALRFSQAGASDIRDQSRNWLPGPCYRQQRVSKTADRNNNSEFSWTGATKYHLNGRDSLVNPGPAMASHKDDEDKFFPQSGVLIFGKEGGDKANADIESVMITDEEEIRTTNPVATEQYGSVSTNLQAGNAQAATADVN

SEQ ID NO: 2802 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQRGNRQAATADVN

SEQ ID NO: 2803 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGTVTLSNLRFSQAGASDIRDQSRNWLPGPCYRQQRVSKQSDRNNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2804 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEDAKGGNVDIERVMITDEEEIRTTNPVATEQYGSVSTNLQAGNAQAATADVN

SEQ ID NO: 2805 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPHTRAADAMVN

SEQ ID NO: 2806 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTASGIHTTSTLQFSQAGASDIRDQSRNWLPGPCYRQQRVSKVSADNNNSEFSWTGATKYHLNGRDSLVNPGPAMASHKDDEEKFFPQSGVLIFGKEGSRGTDVDFDGVMITDEEEIRTTNPVATEQYGSVSTNLQAGNAQAATADVN

SEQ ID NO: 2807 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKKYTDNNNSNFSWTGATTYHLNGRDSLVNPGPAMASHKDDDDRFFPQSGVLIFGKEGATATDAAIDQVMITDEEEIRTTNPVATEQYGSVSTNLQAGNAQAATADVN

SEQ ID NO: 2808 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKVSADNNNSEFSWTGATKYHLNGRDSLVNPGPAMASHKDDEEKFFPQSGVLIFGKESGSGNDVEIDRVMITDEEEIRTTNPVATEQYGSVSTNLQAGNAQAATADVN

SEQ ID NO: 2809 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENGDTSDVAIDNVMITDEEEIRTTNPVATEQYGSVSTNLQAGNAQAATADVN

SEQ ID NO: 2810 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQNGGTGNVAIDRVMITDEEEIRTTNPVATEQYGSVSTNLQAGNAQAATADVN

SEQ ID NO: 2811 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNQTKSELHFSQAGASDIRDQSRNWLPGPCYRQQRVSKTSADNNNSEYSWTGATKYHLNGRDSLVNPGPAMASHRDDNDKFFPQSGVLIFGKEGAAGNNAAVEEVMITDEEEIRTTNPVATEQYGSVSTNLQAGNAQAATADVN

SEQ ID NO: 2812 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSTQASGNNNSEFSWTGATKYHLNGRDSLVNPGPAMASHKDDEDKFFPQSGVLIFGKQDSDKTNAEFGDVMITDEEEIRTTNPVATEQYGSVSTNLQAGNAQAATADVN

SEQ ID NO: 2813 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKESSSATNIDIDRVMITDEEEIRTTNPVATEQYGSVSTNLQAGNAQAATADVN

SEQ ID NO: 2814 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEYSWTGATKYHLNGRDSLVNPGPAMASHKDDEEKFFPQSGVLIFGKQGAAKNNVAVEHVMITDEEEIRTTNPVATEQYGSVSTNLQAGNAQAATADVN

SEQ ID NO: 2815 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDTEKFFPQSGVLIFGKQGSEKTNVDIEKVMITDEEEIRTTNPVATEQYGSVSTNLQAGNAQAATADVN

SEQ ID NO: 2816 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRTGAAVRDVQ

SEQ ID NO: 2817 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGKSGAAFAVVE

SEQ ID NO: 2818 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSNENNNSDFSWTGATTYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 2819 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSAGGTNIDYDSVMITDEEEIRTTNPVATEQYGSVSTNLQAGNAQAATADVN

SEQ ID NO: 2820 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRAQAAFTVVH

SEQ ID NO: 2821 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSHSGLNTNSELNFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2822 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGSVTKSHLMFSQAGASDIRDQSRNWLPGPCYRQQRVSTQPTHNNNSNFSWTGATKYHLNGRDSLVNPGPAMASHRDDDDKFFPQSGVLIFGKENGGGGDVDIDRVMITDEEEIRTTNPVATEQYGSVSTNLQAGNAQAATADVN

SEQ ID NO: 2823 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGINTMSKLLFSQAGASDIRDQSRNWLPGPCYRQQRVSKTSADNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2824 - protein, 334 aa, Artificial Sequence; identical to SEQ ID NO: 357
  Synthetic

SEQ ID NO: 2825 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKKDAENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2826 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGRATNSELRFSQAGASDIRDQSRNWLPGPCYRQQRVSTTPTGNNNSDFSWTGATKYHLNGRDSLVNPGPAMASHKDDDDRFFPQSGVLIFGKEDAGTTNVAFDKVMITDEEEIRTTNPVATEQYGSVSTNLQAGNAQAATADVN

SEQ ID NO: 2827 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTTGLHTKSTLGFSQAGASDIRDQSRNWLPGPCYRQQRVSKKYTDNNNSNFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2828 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTQRTQAADRSVN

SEQ ID NO: 2829 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGQNNNSNFSWTGATKYHLNGRDSLVNPGPAMASHEDDADKFFPQSGVLIFGKQSASENNIDIDRVMITDEEEIRTTNPVATEQYGSVSTNLQAGNAQAATADVN

SEQ ID NO: 2830 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRTGPATQSRLMFSQAGASDIRDQSRNWLPGPCYRQQRVSKQPNDNNNSEFSWTGATTYHLNGRDSLVNPGPAMASHKDDNEKFFPQSGVLIFGKQSAGANNVEIESVMITDEEEIRTTNPVATEQYGSVSTNLQAGNAQAATADVN

SEQ ID NO: 2831 - protein, 334 aa, Artificial Sequence; identical to SEQ ID NO: 101
  Synthetic

SEQ ID NO: 2832 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKKYTDNNNSNFSWTGATTYHLNGRDSLVNPGPAMASHRDDAGRFFPQSGVLIFGKQGSEKTNVDIEKVMITDEEEIRTTNPVATEQYGSVSTNLQRGNRQAATADVN

SEQ ID NO: 2833 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGAKKADTDIGNVMITDEEEIRTTNPVATEQYGSVSTNLQAGNAQAATADVN

SEQ ID NO: 2834 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTQGGNQTQSALRFSQAGASDIRDQSRNWLPGPCYRQQRVSKTADRNNNSEFSWTGATKYHLNGRDSLVNPGPAMASHKDDEDKFFPQSGVLIFGKEGGDKANADIESVMITDEEEIRTTNPVATEQYGSVSTNLQAGNAQAATADVN

SEQ ID NO: 2835 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSGKRANVEIDQVMITDEEEIRTTNPVATEQYGSVSTNLQAGNAQAATADVN

SEQ ID NO: 2836 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYTDNNNSNFSWTGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 2837 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGPVTPSNLRFSQAGASDIRDQSRNWLPGPCYRQQRVSTTPADNNNSDFSWTGATKYHLNGRDSLVNPGPAMASHKDDDEKFFPQSGVLIFGKQGSKGSNIEYGDVMITDEEEIRTTNPVATEQYGSVSTNLQAGNAQAATADVN

SEQ ID NO: 2838 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGINTLSTLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2839 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGKQSQAAYSTVN

SEQ ID NO: 2840 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 2841 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGTGASNVEVENVMITDEEEIRTTNPVATEQYGSVSTNLQAGNAQAATADVN

SEQ ID NO: 2842 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 2843 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENGRGGNAEVEDVMITDEEEIRTTNPVATEQYGSVSTNLQAGNAQAATADVN

SEQ ID NO: 2844 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKDRAAAAVHNVH

SEQ ID NO: 2845 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSGGNMTHSALRFSQAGASDIRDQSRNWLPGPCYRQQRVSKQSDHNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2846 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAGKTDVAIGRVMITDEEEIRTTNPVATEQYGSVSTNLQAGNAQAATADVN

SEQ ID NO: 2847 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSTKDDRNNNSDFSWTGATKYHLNGRDSLVNPGPAMASHKDDDEKFFPQSGVLIFGKEGAGTNDIDIERVMITDEEEIRTTNPVATEQYGSVSTNLQAGNAQAATADVN

SEQ ID NO: 2848 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHKDDDEKFFPQSGVLIFGKQGAGKDDIAIDNVMITDEEEIRTTNPVATEQYGSVSTNLQTRQTTAATDDVP

SEQ ID NO: 2849 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTEGGSTTTSKLKFSQAGASDIRDQSRNWLPGPCYRQQRVSKTAADNNNSDFSWTGATKYHLNGRDSLVNPGPAMASHKDDDGKFFPQSGVLIFGKEDGKATDADIGQVMITDEEEIRTTNPVATEQYGSVSTNLQAGNAQAATADVN

SEQ ID NO: 2850 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGTGHDTTSSLVFSQAGASDIRDQSRNWLPGPCYRQQRVSKVSADNNNSEFSWTGATKYHLNGRDSLVNPGPAMASHKDDEEKFFPQSGVLIFGKQSAKAANAAIDEVMITDEEEIRTTNPVATEQYGSVSTNLQAGNAQAATADVN

SEQ ID NO: 2851 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQETRDRAASTVVD

SEQ ID NO: 2852 - protein, 334 aa, Artificial Sequence; identical to SEQ ID NO: 483
  Synthetic

SEQ ID NO: 2853 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSEKTNVDIEKVMITDEEEIRTTNPVATEQYGSVSTNLQRGNRQAATADVN

SEQ ID NO: 2854 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSGKNNADIEKVMITDEEEIRTTNPVATEQYGSVSTNLQAGNAQAATADVN

SEQ ID NO: 2855 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQSASKNNIAIEEVMITDEEEIRTTNPVATEQYGSVSTNLQAGNAQAATADVN

SEQ ID NO: 2856 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSNFSWTGATKYHLNGRDSLVNPGPAMASHKDDDDRFFPQSGVLIFGKEDAGKADVEIGKVMITDEEEIRTTNPVATEQYGSVSTNLQAGNAQAATADVN

SEQ ID NO: 2857 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 2858 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRGGAADEEVN

SEQ ID NO: 2859 - protein, 334 aa, Artificial Sequence
  Synthetic
ESGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQPTGNNNSEFSWTGATKYHLNGRDSLVNPGPAMASHKDDNGRFFPQSGVLIFGKQGSEKTNVDIEKVMITDEEEIRTTNPVATEQYGSVSTNLQRGNRQAATADVN

SEQ ID NO: 2860 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPANGNNNSEFSWTGATKYHLNGRDSLVNPGPAMASHKDDDDRFFPQSGVLIFGKQGSDGSDADIDEVMITDEEEIRTTNPVATEQYGSVSTNLQAGNAQAATADVN

SEQ ID NO: 2861 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGGGGSNVAIDGVMITDEEEIRTTNPVATEQYGSVSTNLQAGNAQAATADVN

SEQ ID NO: 2862 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKQGAGETNVDVGKVMITDEEEIRTTNPVATEQYGSVSTNLQAGNAQAATADVN

SEQ ID NO: 2863 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTSADNNNSEFSWTGATKYHLNGRDSLVNPGPAMASHRDDADKFFPQSGVLIFGKQNARKANIDIGEVMITDEEEIRTTNPVATEQYGSVSTNLQAGNAQAATADVN

SEQ ID NO: 2864 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKDKFFPQSGVLIFGKEGSAASNVDIGGVMITDEEEIRTTNPVATEQYGSVSTNLQAGNAQAATADVN

SEQ ID NO: 2865 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKSGLATKSNLGFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 2866 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEERFFPQSGVLIFGKESAEGGNVEIGSVMITDEEEIRTTNPVATEQYGSVSTNLQAGNAQAATADVN

SEQ ID NO: 2867 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADKFFPQSGVLIFGKESGSATNIDFEDVMITDEEEIRTTNPVATEQYGSVSTNLQAGNAQAATADVN

SEQ ID NO: 2868 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGTLTNSRLRFSQAGASDIRDQSRNWLPGPCYRQQRVSKTDGENNNSNFSWTGATTYHLNGRDSLVNPGPAMASHKDDDEKFFPQSGVLIFGKQSANESDVDIDQVMITDEEEIRTTNPVATEQYGSVSTNLQAGNAQAATADVN

SEQ ID NO: 2869 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNNTTSGLQFSQAGASDIRDQSRNWLPGPCYRQQRVSKTSDGNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2870 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKKDAENNNSEFSWPGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 2871 - protein, 334 aa, Artificial Sequence
  Synthetic
ETGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSTLGFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2872 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 2873 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGTGPMTKSKLGFSQAGASDIRDQSRNWLPGPCYRQQRVSKQDGHNNNSDFSWTGATTYHLNGRDSLVNPGPAMASHKDDDDKFFPQSGVLIFGKEGAGRNNTDIDDVMITDEEEIRTTNPVATEQYGSVSTNLQAGNAQAATADVN

SEQ ID NO: 2874 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGNMTLSRLKFSQAGASDIRDQSRNWLPGPCYRQQRVSKKDTDNNNSEFSWTGATTYHLNGRDSLVNPGPAMASHKDDNDKFFPQSGVLIFGKQGSEKTNVDIEKVMITDEEEIRTTNPVATEQYGSVSTNLQAGNAQAATADVN

SEQ ID NO: 2875 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKEGTTRTDVEIGSVMITDEEEIRTTNPVATEQYGSVSTNLQAGNAQAATADVN

SEQ ID NO: 2876 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDARRNNAEIGSVMITDEEEIRTTNPVATEQYGSVSTNLQAGNAQAATADVN

SEQ ID NO: 2877 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHRDDEDKFFPQSGVLIFGKQGARGTDVAFEHVMITDEEEIRTTNPVATEQYGSVSTNLQAGNAQAATADVN

SEQ ID NO: 2878 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 2879 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 2880 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPARNNNSNFSWTGATTYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 2881 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSTLKFSQAGASDIRDQSRNWLPGPCYRQQRVSTQSTGNNNSNFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2882 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKQSGNGNNVDFEHVMITDEEEIRTTNPVATEQYGSVSTNLQAGNAQAATADVN

SEQ ID NO: 2883 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKSGSHTQSELKFSQAGASDIRDQSRNWLPGPCYRQQRVSKTSADNNNSEYSWTGATKYHLNGRDSLVNPGPAMASHKDDEEKFFPQSGVLIFGKEGATKSNAAFEEVMITDEEEIRTTNPVATEQYGSVSTNLQAGNAQAATADVN

SEQ ID NO: 2884 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTNTQSGLRFSQAGASDIRDQSRNWLPGPCYRQQRVSKVSADNNNSEFSWTGATKYHLNGRDSLVNPGPAMASHKDDEEKFFPQSGVLIFGKQGGGESDVEIDKVMITDEEEIRTTNPVATEQYGSVSTNLQAGNAQAATADVN

SEQ ID NO: 2885 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGPTTQSKLQFSQAGASDIRDQSRNWLPGPCYRQQRVSKQPNDNNNSEFSWTGATTYHLNGRDSLVNPGPAMASHKDDDERFFPQSGVLIFGKQSSGKSNIAIEGVMITDEEEIRTTNPVATEQYGSVSTNLQAGNAQAATADVN

SEQ ID NO: 2886 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGSSSGAATTMVQ

SEQ ID NO: 2887 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGNITLSKLRFSQAGASDIRDQSRNWLPGPCYRQQRVSKTPAENNNSNFSWTGATTYHLNGRDSLVNPGPAMASHEDDAEKFFPQSGVLIFGKEGAEATDIAIDKVMITDEEEIRTTNPVATEQYGSVSTNLQAGNAQAATADVN

SEQ ID NO: 2888 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHKDDDDRFFPQSGVLIFGKEGAGKTNIAVDRVMITDEEEIRTTNPVATEQYGSVSTNLQAGNAQAATADVN

SEQ ID NO: 2889 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKENASGTNVDIGNVMITDEEEIRTTNPVATEQYGSVSTNLQAGNAQAATADVN

SEQ ID NO: 2890 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNKTQSALGFSQAGASDIRDQSRNWLPGPCYRQQRVSKTSNGNNNSDFSWTGATKYHLNGRDSLVNPGPAMASHGDDKEKFFPQSGVLIFGKQGSEKTNVDIEKVMITDEEEIRTTNPVATEQYGSVSTNLQAGNAQAATADVN

SEQ ID NO: 2891 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNATIGQVMITDEEEIRTTNPVATEQYGSVSTNLQAGNAQAATADVN

SEQ ID NO: 2892 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2893 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQSGTGTDVDIGRVMITDEEEIRTTNPVATEQYGSVSTNLQAGNAQAATADVN

SEQ ID NO: 2894 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKEGTGAANIDIGEVMITDEEEIRTTNPVATEQYGSVSTNLQAGNAQAATADVN

SEQ ID NO: 2895 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGRFFPQSGVLIFGKEGAKKNNVAFDGVMITDEEEIRTTNPVATEQYGSVSTNLQAGNAQAATADVN

SEQ ID NO: 2896 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRSGPNTTSALMFSQAGASDIRDQSRNWLPGPCYRQQRVSKTSADNNNSEYSWTGATKYHLNGRDSLVNPGPAMASHKDDEDKFFPQSGVLIFGKESAGKTNVAIGEVMITDEEEIRTTNPVATEQYGSVSTNLQAGNAQAATADVN

SEQ ID NO: 2897 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGNHTTSKLNFSQAGASDIRDQSRNWLPGPCYRQQRVSTQPTHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2898 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDTEKFFPQSGVLIFGKQGTGASNADIDHVMITDEEEIRTTNPVATEQYGSVSTNLQAGNAQAATADVN

SEQ ID NO: 2899 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKESGEKNNIDIDGVMITDEEEIRTTNPVATEQYGSVSTNLQAGNAQAATADVN

SEQ ID NO: 2900 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGASTTNAAIEDVMITDEEEIRTTNPVATEQYGSVSTNLQAGNAQAATADVN

SEQ ID NO: 2901 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGPATLSTLKFSQAGASDIRDQSRNWLPGPCYRQQRVSTTPADNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2902 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSEKTNVDIKKVMITDEEEIRTTNPVATEQYGSVSTNLQAGNAQAATADVN

SEQ ID NO: 2903 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDTDNNNSNFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 2904 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHKDDDDRFFPQSGVLIFGKQGSEKTNVDIEKVMITDEEEIRTTNPVATEQYGSVSTNLQGTKAAAAITSVQ

SEQ ID NO: 2905 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPSGSPTPSALRFSQAGASDIRDQSRNWLPGPCYRQQRVSKVSADNNNSEFSWTGATKYHLNGRDSLVNPGPAMASHKDDEEKFFPQSGVLIFGKENGRGSNIDIGKVMITDEEEIRTTNPVATEQYGSVSTNLQAGNAQAATADVN

SEQ ID NO: 2906 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGSATNSRLRFSQAGASDIRDQSRNWLPGPCYRQQRVSTTPADNNNSDFSWTGATKYHLNGRDSLVNPGPAMASHKDDDEKFFPQSGVLIFGKENSGKANVDIEQVMITDEEEIRTTNPVATEQYGSVSTNLQAGNAQAATADVN

SEQ ID NO: 2907 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDAGRFFPQSGVLIFGKQGSEKTNVDIEKVMITDEEEIRTTNPVATEQYGSVSTNLQAGNAQAATADVN

SEQ ID NO: 2908 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGQGRAAAHDVD

SEQ ID NO: 2909 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNGSASAATSSVK

SEQ ID NO: 2910 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNQTTSALGFSQAGASDIRDQSRNWLPGPCYRQQRVSKVSADNNNSEFSWTGATKYHLNGRDSLVNPGPAMASHKDDEEKFFPQSGVLIFGKEGAGKADIEIGKVMITDEEEIRTTNPVATEQYGSVSTNLQAGNAQAATADVN

SEQ ID NO: 2911 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2912 - protein, 334 aa, Artificial Sequence; identical to SEQ ID NO: 466
  Synthetic

SEQ ID NO: 2913 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKPSGNNNSNFSWTGATTYHLNGRDSLVNPGPAMASHKDDDDRFFPQSGVLIFGKQGASAADVEIEDVMITDEEEIRTTNPVATEQYGSVSTNLQAGNAQAATADVN

SEQ ID NO: 2914 - protein, 334 aa, Artificial Sequence; identical to SEQ ID NO: 348
  Synthetic

SEQ ID NO: 2915 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 2916 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEGAAANNVEIDGVMITDEEEIRTTNPVATEQYGSVSTNLQAGNAQAATADVN

SEQ ID NO: 2917 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGNQTISSLGFSQAGASDIRDQSRNWLPGPCYRQQRVSTQDGQNNNSNFSWTGATKYHLNGRDSLVNPGPAMASHGDDEEKFFPQSGVLIFGKQGSEKTNVDIEKVMITDEEEIRTTNPVATEQYGSVSTNLQAGNAQAATADVN

SEQ ID NO: 2918 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNKTHSRLGFSQAGASDIRDQSRNWLPGPCYRQQRVSTTPADNNNSDFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 2919 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGTVTTSHLRFSQAGASDIRDQSRNWLPGPCYRQQRVSTQASGNNNSEFSWTGATKYHLNGRDSLVNPGPAMASHKDDEEKFFPQSGVLIFGKQDGGKTDVAFEEVMITDEEEIRTTNPVATEQYGSVSTNLQAGNAQAATADVN

SEQ ID NO: 2920 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAGGSETISGLQFSQAGASDIRDQSRNWLPGPCYRQQRVSKTSADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 2921 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRNATAAFSVVD

SEQ ID NO: 2922 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQSAKAANAAIDEVMITDEEEIRTTNPVATEQYGSVSTNLQAGNAQAATADVN

SEQ ID NO: 2923 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNATISRLRFSQAGASDIRDQSRNWLPGPCYRQQRVSKTADHNNNSDFSWTGATTYHLNGRDSLVNPGPAMASHKDDDERFFPQSGVLIFGKEGTSKGDVAIGDVMITDEEEIRTTNPVATEQYGSVSTNLQAGNAQAATADVN

SEQ ID NO: 2924 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKEDTGKANVDIGNVMITDEEEIRTTNPVATEQYGSVSTNLQAGNAQAATADVN

SEQ ID NO: 2925 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2926 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNSGILTTSTLRFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQTHKNGAASGEVT

SEQ ID NO: 2927 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGLQTLSDLRFSQAGASDIRDQSRNWLPGPCYRQQRVSKPDNRNNTSDFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 2928 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRAAAAYTTVD

SEQ ID NO: 2929 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHRDDAGRFFPQSGVLIFGKQSGGRSNVEIDQVMITDEEEIRTTNPVATEQYGSVSTNLQAGNAQAATADVN

SEQ ID NO: 2930 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGGAGSDVAYEDVMITDEEEIRTTNPVATEQYGSVSTNLQAGNAQAATADVN

SEQ ID NO: 2931 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQSSDNNNSEFSWTGATKYHLNGRDSLVNPGPAMASHKDDDEKFFPQSGVLIFGKQNGRKGNVAIEEVMITDEEEIRTTNPVATEQYGSVSTNLQAGNAQAATADVN

SEQ ID NO: 2932 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSAGINTLSNLHFSQAGASDIRDQSRNWLPGPCYRQQRVSKQDAENNNSNFSWTGATKYHLNGRDSLVNPGPAMASHKDDEEKFFPQSGVLIFGKQDAGGNDVAIDKVMITDEEEIRTTNPVATEQYGSVSTNLQAGNAQAATADVN

SEQ ID NO: 2933 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGPVTPSNLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2934 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 2935 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 2936 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTSRDTAANNKVE

SEQ ID NO: 2937 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQASSNHAAAKGVD

SEQ ID NO: 2938 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSGGNNNSNFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 2939 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRGQAADNGVD

SEQ ID NO: 2940 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPDQNNNSEFSWTGATKYHLNGRDSLVNPGPAMASHKDDEGRFFPQSGVLIFGKEDTGKANVDIGNVMITDEEEIRTTNPVATEQYGSVSTNLQAGNAQAATADVN

SEQ ID NO: 2941 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESSSATNIDIDRVMITDEEEIRTTNPVATEQYGSVSTNLQAGNAQAATADVN

SEQ ID NO: 2942 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNQTNSDLKFSQAGASDIRDQSRNWLPGPCYRQQRVSKTSTENNNSEFSWTGATTYHLNGRDSLVNPGPAMASHEDDKDKFFPQSGVLIFGKQGSEKTNVDIEKVMITDEEEIRTTNPVATEQYGSVSTNLQAGNAQAATADVN

SEQ ID NO: 2943 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDAGRNDVEFDKVMITDEEEIRTTNPVATEQYGSVSTNLQRGNRQAATADVN

SEQ ID NO: 2944 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 2945 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHKDDADKFFPQSGVLIFGKQDGARDDAAIEDVMITDEEEIRTTNPVATEQYGSVSTNLQAGNAQAATADVN

SEQ ID NO: 2946 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGARANNVDFENVMITDEEEIRTTNPVATEQYGSVSTNLQAGNAQAATADVN

SEQ ID NO: 2947 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTSGNQTKSGLRFSQAGASDIRDQSRNWLPGPCYRQQRVSKQHNQNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 2948 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 2949 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTAAHNNNSDFSWTGATKYHLNGRDSLVNPGPAMASHKDDDDKFFPQSGVLIFGKENGREGNAAIEHVMITDEEEIRTTNPVATEQYGSVSTNLQAGNAQAATADVN

SEQ ID NO: 2950 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQGARNAAAAEGVE

SEQ ID NO: 2951 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKEGTEKSNVAIEHVMITDEEEIRTTNPVATEQYGSVSTNLQAGNAQAATADVN

SEQ ID NO: 2952 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKEGTGRNDVAIEEVMITDEEEIRTTNPVATEQYGSVSTNLQAGNAQAATADVN

SEQ ID NO: 2953 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDAENNNSEFSWPGATTYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 2954 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSTAKTDADFDSVMITDEEEIRTTNPVATEQYGSVSTNLQAGNAQAATADVN

SEQ ID NO: 2955 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDTGHTTISRLGFSQAGASDIRDQSRNWLPGPCYRQQRVSKQASDNNNSEFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 2956 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 2957 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQKDRAAAAVHNVH

SEQ ID NO: 2958 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNAPSGTTTQSRLQFSQAGASDIRDQSRNWLPGPCYRQQRVSKTSADNNNSNFSWTGATTYHLNGRDSLVNPGPAMASHKDDEDKFFPQSGVLIFGKENSGRTDVEIGEVMITDEEEIRTTNPVATEQYGSVSTNLQAGNAQAATADVN

SEQ ID NO: 2959 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAGGSNVAVDGVMITDEEEIRTTNPVATEQYGSVSTNLQAGNAQAATADVN

SEQ ID NO: 2960 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNAGTKTQSKLQFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 2961 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGNITLSKLRFSQAGASDIRDQSRNWLPGPCYRQQRVSKQDAENNNSEFSWPGATKYHLNGRDSLVNPGPAMASHKDDEEKFFPQSGVLIFGKEGTKTNNAAVDEVMITDEEEIRTTNPVATEQYGSVSTNLQAGNAQAATADVN

SEQ ID NO: 2962 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSKQANHNNNSEFSWTGATTYHLNGRDSLVNPGPAMASHKDDDDRFFPQSGVLIFGKQSGKTADAEVGDVMITDEEEIRTTNPVATEQYGSVSTNLQAGNAQAATADVN

SEQ ID NO: 2963 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHRDDDDKFFPQSGVLIFGKEDAKGSNADIDHVMITDEEEIRTTNPVATEQYGSVSTNLQAGNAQAATADVN

SEQ ID NO: 2964 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKEDSGAGNVAVEGVMITDEEEIRTTNPVATEQYGSVSTNLQAGNAQAATADVN

SEQ ID NO: 2965 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGHDTTSELRFSQAGASDIRDQSRNWLPGPCYRQQRVSTTPADNNNSDFSWTGATKYHLNGRDSLVNPGPAMASHKDDDGKFFPQSGVLIFGKQGSEKTNVDIEKVMITDEEEIRTTNPVATEQYGSVSTNLQRGNRQAATADVN

SEQ ID NO: 2966 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDNDRFFPQSGVLIFGKEGTGANNAEIGEVMITDEEEIRTTNPVATEQYGSVSTNLQAGNAQAATADVN

SEQ ID NO: 2967 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKKYTDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2968 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDRFFPQSGVLIFGKQGSEKTNVDIEKVMITDEEEIRTTNPVATEQYGSVSTNLQARSNRAAFDVVH

SEQ ID NO: 2969 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDKFFPQSGVLIFGKESTRGTNIDIGDVMITDEEEIRTTNPVATEQYGSVSTNLQAGNAQAATADVN

SEQ ID NO: 2970 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 2971 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENSTRTDAAIDEVMITDEEEIRTTNPVATEQYGSVSTNLQAGNAQAATADVN

SEQ ID NO: 2972 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGNITLSKLRFSQAGASDIRDQSRNWLPGPCYRQQRVSKKPADNNNSNFSWTGATKYHLNGRDSLVNPGPAMASHKDDDEKFFPQSGVLIFGKQGTGGSDVAIDNVMITDEEEIRTTNPVATEQYGSVSTNLQAGNAQAATADVN

SEQ ID NO: 2973 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 2974 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSDFSWTGATKYHLNGRDSLVNPGPAMASHKDDDDRFFPQSGVLIFGKQGAKGTDVAYDGVMITDEEEIRTTNPVATEQYGSVSTNLQAGNAQAATADVN

SEQ ID NO: 2975 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGHRNGAADANVE

SEQ ID NO: 2976 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDRFFPQSGVLIFGKQDADATDVAIDRVMITDEEEIRTTNPVATEQYGSVSTNLQAGNAQAATADVN

SEQ ID NO: 2977 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWPGATKYHLNGRDSLVNPGPAMASHGDDKEKFFPQSGVLIFGKQGSEKTNVDIEKVMITDEEEIRTTNPVATEQYGSVSTNLQAGNAQAATADVN

SEQ ID NO: 2978 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTADGNNNSEFSWTGATTYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 2979 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNDTTSNLGFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2980 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGSEKTNVDIEKVMITDEEEIRTTNPVATEQYGSVSTNLQRGNRQAATADVN

SEQ ID NO: 2981 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHEDDTGRFFPQSGVLIFGKEGTDKANVDIDGVMITDEEEIRTTNPVATEQYGSVSTNLQAGNAQAATADVN

SEQ ID NO: 2982 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHEDDDDRFFPQSGVLIFGKQGSGRDDIDIDRVMITDEEEIRTTNPVATEQYGSVSTNLQAGNAQAATADVN

SEQ ID NO: 2983 - protein, 334 aa, Artificial Sequence
  Synthetic
PAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 2984 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRKDTAATNNVA

SEQ ID NO: 2985 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGSTTMSKLMFSQAGASDIRDQSRNWLPGPCYRQQRVSKQSSDNNNSEFSWTGATKYHLNGRDSLVNPGPAMASHRDDDDKFFPQSGVLIFGKESGTRGDVDVGQVMITDEEEIRTTNPVATEQYGSVSTNLQAGNAQAATADVN

SEQ ID NO: 2986 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQASGNNNSNFSWTGATKYHLNGRDSLVNPGPAMASHKDDEDKFFPQSGVLIFGKEGASKTNIEYGQVMITDEEEIRTTNPVATEQYGSVSTNLQAGNAQAATADVN

SEQ ID NO: 2987 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQNSTANNVDVGSVMITDEEEIRTTNPVATEQYGSVSTNLQAGNAQAATADVN

SEQ ID NO: 2988 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGHPTHSDLGFSQAGASDIRDQSRNWLPGPCYRQQRVSKTAADNNNSDFSWTGATKYHLNGRDSLVNPGPAMASHRDDAGRFFPQSGVLIFGKEDAGTTNVAFDKVMITDEEEIRTTNPVATEQYGSVSTNLQAGNAQAATADVN

SEQ ID NO: 2989 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 2990 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPRGGAAVQKVA

SEQ ID NO: 2991 - protein, 334 aa, Artificial Sequence; identical to SEQ ID NO: 314
  Synthetic

SEQ ID NO: 2992 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKENAEGADVDIEKVMITDEEEIRTTNPVATEQYGSVSTNLQAGNAQAATADVN

SEQ ID NO: 2993 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRSTAADAEVQ

SEQ ID NO: 2994 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTENNNSEFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 2995 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPAGNTTLSRLLFSQAGASDIRDQSRNWLPGPCYRQQRVSKKYTDNNNSNFSWTGATTYHLNGRDSLVNPGPAMASHKDDEGRFFPQSGVLIFGKENAGKSDVEIEHVMITDEEEIRTTNPVATEQYGSVSTNLQAGNAQAATADVN

SEQ ID NO: 2996 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 2997 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPTDNNNSEFSWTGATKYHLNGRDSLVNPGPAMASHKDDNEKFFPQSGVLIFGKQGSAAANIEIEQVMITDEEEIRTTNPVATEQYGSVSTNLQAGNAQAATADVN

SEQ ID NO: 2998 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKHGGNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 2999 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 3000 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNSSGIITQSALRFSQAGASDIRDQSRNWLPGPCYRQQRVSKTSTENNNSEFSWTGATTYHLNGRDSLVNPGPAMASHKDDDDKFFPQSGVLIFGKQNSSGNDIEIDQVMITDEEEIRTTNPVATEQYGSVSTNLQAGNAQAATADVN

SEQ ID NO: 3001 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQNTGGGNVDIEHVMITDEEEIRTTNPVATEQYGSVSTNLQAGNAQAATADVN

SEQ ID NO: 3002 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGTNESDVDIEKVMITDEEEIRTTNPVATEQYGSVSTNLQAGNAQAATADVN

SEQ ID NO: 3003 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGNATPSQLIFSQAGASDIRDQSRNWLPGPCYRQQRVSKTSDGNNNSDFSWTGATKYHLNGRDSLVNPGPAMASHEDDKDKFFPQSGVLIFGKENASGTNVDIGNVMITDEEEIRTTNPVATEQYGSVSTNLQAGNAQAATADVN

SEQ ID NO: 3004 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDTSTNNVEIEGVMITDEEEIRTTNPVATEQYGSVSTNLQAGNAQAATADVN

SEQ ID NO: 3005 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNAGGPTTTSTLMFSQAGASDIRDQSRNWLPGPCYRQQRVSKKASDNNNSNFSWTGATKYHLNGRDSLVNPGPAMASHKDDDDRFFPQSGVLIFGKQGSEKTNVDIEKVMITDEEEIRTTNPVATEQYGSVSTNLQRGNAQAATADVN

SEQ ID NO: 3006 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 3007 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSPRATAAVKGVD

SEQ ID NO: 3008 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNSGILTTSTLRFSQAGASDIRDQSRNWLPGPCYRQQRVSKTSADNNNSNFSWTGATKYHLNGRDSLVNPGPAMASHRDDEDKFFPQSGVLIFGKEGARKTNIDIDEVMITDEEEIRTTNPVATEQYGSVSTNLQAGNAQAATADVN

SEQ ID NO: 3009 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDDKFFPQSGVLIFGKQNTRRGDIEIEDVMITDEEEIRTTNPVATEQYGSVSTNLQAGNAQAATADVN

SEQ ID NO: 3010 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEEKFFPQSGVLIFGKQGTEKTNVDIEKVMITDEEEIRTTNPVATEQYGSVSTNLQAGNAQAATADVN

SEQ ID NO: 3011 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTTGLHTKSTLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3012 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDAKGDNADFEDVMITDEEEIRTTNPVATEQYGSVSTNLQAGNAQAATADVN

SEQ ID NO: 3013 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNAGNATMSNLKFSQAGASDIRDQSRNWLPGPCYRQQRVSKTHGDNNNSNFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 3014 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGARGADAEIESVMITDEEEIRTTNPVATEQYGSVSTNLQAGNAQAATADVN

SEQ ID NO: 3015 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQGGSTTLSRLGFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 3016 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRDGAAAEDVA

SEQ ID NO: 3017 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSGDNNNSDFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 3018 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3019 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAPNGRAATQIVD

SEQ ID NO: 3020 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3021 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGGGNLTQSRLNFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3022 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKQGGGATDVEIGNVMITDEEEIRTTNPVATEQYGSVSTNLQAGNAQAATADVN

SEQ ID NO: 3023 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 3024 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGTHTLSHLLFSQAGASDIRDQSRNWLPGPCYRQQRVSTQSTQNNNSEFSWTGATTYHLNGRDSLVNPGPAMASHKDDDERFFPQSGVLIFGKEGAGANDVAYENVMITDEEEIRTTNPVATEQYGSVSTNLQAGNAQAATADVN

SEQ ID NO: 3025 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKGSGGAANTEVT

SEQ ID NO: 3026 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 3027 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGKFFPQSGVLIFGKQSAETGNADIGQVMITDEEEIRTTNPVATEQYGSVSTNLQAGNAQAATADVN

SEQ ID NO: 3028 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3029 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKESAEKSNAAIERVMITDEEEIRTTNPVATEQYGSVSTNLQAGNAQAATADVN

SEQ ID NO: 3030 - protein, 334 aa, Artificial Sequence
  Synthetic
ESGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 3031 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGTVTTSHLRFSQAGASDIRDQSRNWLPGPCYRQQRVSKQSDRNNNSEFSWTGATKYHLNGRDSLVNPGPAMASHKDDEDKFFPQSGVLIFGKEGSAGSNAAIDNVMITDEEEIRTTNPVATEQYGSVSTNLQAGNAQAATADVN

SEQ ID NO: 3032 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTSADNNNSEYSWTGATTYHLNGRDSLVNPGPAMASHKDDEEKFFPQSGVLIFGKQGSDTNNVEIDRVMITDEEEIRTTNPVATEQYGSVSTNLQAGNAQAATADVN

SEQ ID NO: 3033 - protein, 334 aa, Artificial Sequence; identical to SEQ ID NO: 381
  Synthetic

SEQ ID NO: 3034 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQDAAGANIEIGNVMITDEEEIRTTNPVATEQYGSVSTNLQAGNAQAATADVN

SEQ ID NO: 3035 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKPPNGNNNSEFSWTGATTYHLNGRDSLVNPGPAMASHKDDDDRFFPQSGVLIFGKQGASTTNAAIEDVMITDEEEIRTTNPVATEQYGSVSTNLQAGNAQAATADVN

SEQ ID NO: 3036 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 3037 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTKTGNVTKSTLHFSQAGASDIRDQSRNWLPGPCYRQQRVSKQSADNNNSDFSWTGATKYHLNGRDSLVNPGPAMASHGDDTGKFFPQSGVLIFGKQGSEKTNVDIEKVMITDEEEIRTTNPVATEQYGSVSTNLQAGNAQAATADVN

SEQ ID NO: 3038 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHGGNKTISNLRFSQAGASDIRDQSRNWLPGPCYRQQRVSTQSTGNNNSDFSWTGATKYHLNGRDSLVNPGPAMASHKDDEEKFFPQSGVLIFGKQGGGGTDVEIEKVMITDEEEIRTTNPVATEQYGSVSTNLQAGNAQAATADVN

SEQ ID NO: 3039 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDGKFFPQSGVLIFGKQSGEKNDVDIDGVMITDEEEIRTTNPVATEQYGSVSTNLQAGNAQAATADVN

SEQ ID NO: 3040 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3041 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENSDASNVDVEEVMITDEEEIRTTNPVATEQYGSVSTNLQAGNAQAATADVN

SEQ ID NO: 3042 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAHAHAAFAEVN

SEQ ID NO: 3043 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNPGGPLTKSPLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 3044 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSNSTQAAYHVVE

SEQ ID NO: 3045 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQNAGASDADFDQVMITDEEEIRTTNPVATEQYGSVSTNLQAGNAQAATADVN

SEQ ID NO: 3046 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGTLTPSGLGFSQAGASDIRDQSRNWLPGPCYRQQRVSKTHGDNNNSNFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 3047 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQASGNNNSNFSWTGATKYHLNGRDSLVNPGPAMASHKDDEDKFFPQSGVLIFGKEGASKTNIEYGQVMITDEEEIRTTNPVATEQYGSVSTNLQAGNAQAATADVN

SEQ ID NO: 3048 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSTQYDRNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3049 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGRTGTLTHSELSFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3050 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATTYHLNGRDSLVNPGPAMASHKDDADRFFPQSGVLIFGKEGAGKDNVDYGRVMITDEEEIRTTNPVATEQYGSVSTNLQAGNAQAATADVN

SEQ ID NO: 3051 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDANTNNADVDSVMITDEEEIRTTNPVATEQYGSVSTNLQAGNAQAATADVN

SEQ ID NO: 3052 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTTPADNNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3053 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQETRSEAAYDEVN

SEQ ID NO: 3054 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQDGSGGNTEIDGVMITDEEEIRTTNPVATEQYGSVSTNLQAGNAQAATADVN

SEQ ID NO: 3055 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGNVTNSSLRFSQAGASDIRDQSRNWLPGPCYRQQRVSKQASDNNNSNFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3056 - protein, 334 aa, Artificial Sequence
  Synthetic
ESGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWKGATTYHLNGRDSLVNPGPAMASHKDDAGKFFPQSGVLIFGKQDSGATDIEIDRVMITDEEEIRTTNPVATEQYGSVSTNLQAGNAQAATADVN

SEQ ID NO: 3057 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQGQKDRAASTDVH

SEQ ID NO: 3058 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQDAENNNSEFSWPGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 3059 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQGAQTRAASKEVH

SEQ ID NO: 3060 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKEGAGTTDTEYEQVMITDEEEIRTTNPVATEQYGSVSTNLQAGNAQAATADVN

SEQ ID NO: 3061 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGRMTMSKLQFSQAGASDIRDQSRNWLPGPCYRQQRVSKTDGENNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 3062 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDNEKFFPQSGVLIFGKQGTGKANIDIGRVMITDEEEIRTTNPVATEQYGSVSTNLQAGNAQAATADVN

SEQ ID NO: 3063 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDESGPNTTSGLKFSQAGASDIRDQSRNWLPGPCYRQQRVSKTPNGNNNSDFSWTGATKYHLNGRDSLVNPGPAMASHRDDAGRFFPQSGVLIFGKESGSKSNIAIDQVMITDEEEIRTTNPVATEQYGSVSTNLQAGNAQAATADVN

SEQ ID NO: 3064 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNGKFFPQSGVLIFGKQDANRNNVEIGQVMITDEEEIRTTNPVATEQYGSVSTNLQAGNAQAATADVN

SEQ ID NO: 3065 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNKTLSRLKFSQAGASDIRDQSRNWLPGPCYRQQRVSKKYTDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3066 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSGGNNNSEFSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 3067 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEESFFPQSGVLIFGKQGSEKTNVDIEKVMITDEEEIRTTNPVATEQYGSVSTNLQRGNRQAATADVN

SEQ ID NO: 3068 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSTQDSDNNNSNFSWTGATKYHLNGRDSLVNPGPAMASHKDDEEKFFPQSGVLIFGKEGGTKNDVAIDGVMITDEEEIRTTNPVATEQYGSVSTNLQAGNAQAATADVN

SEQ ID NO: 3069 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGHMTLSGLRFSQAGASDIRDQSRNWLPGPCYRQQRVSKTSADNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3070 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKEDAGKADVEIGKVMITDEEEIRTTNPVATEQYGSVSTNLQAGNAQAATADVN

SEQ ID NO: 3071 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSEKTNVDIEKVMITDEEEIRTTNPVATEQYGSVSTNLQDPRGGAAVQKVA

SEQ ID NO: 3072 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHKNGAASGEVT

SEQ ID NO: 3073 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDDDRFFPQSGVLIFGKEDASKTNVAIGQVMITDEEEIRTTNPVATEQYGSVSTNLQAGNAQAATADVN

SEQ ID NO: 3074 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNREFSWTGATTYHLNGRDSLVNPGPAMASHKDDDDRFFPQSGVLIFGKEGSAGSNTEFDQVMITDEEEIRTTNPVATEQYGSVSTNLQAGNAQAATADVN

SEQ ID NO: 3075 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESTGGNDVEYDQVMITDEEEIRTTNPVATEQYGSVSTNLQAGNAQAATADVN

SEQ ID NO: 3076 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSTKHGGNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3077 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDASGTNVDFDRVMITDEEEIRTTNPVATEQYGSVSTNLQAGNAQAATADVN

SEQ ID NO: 3078 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGPTTLSRLGFSQAGASDIRDQSRNWLPGPCYRQQRVSKQASDNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3079 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 3080 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3081 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGKAHAADRSVN

SEQ ID NO: 3082 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDEGRFFPQSGVLIFGKQGSRGNDVDVEEVMITDEEEIRTTNPVATEQYGSVSTNLQAGNAQAATADVN

SEQ ID NO: 3083 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLRFSQAGASDIRDQSRNWLPGPCYRQQRVSKKDDGNNNSNFSWTGATKYHLNGRDSLVNPGPAMASHRDDDDKFFPQSGVLIFGKQGATKDDVDFDGVMITDEEEIRTTNPVATEQYGSVSTNLQAGNAQAATADVN

SEQ ID NO: 3084 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENAGGDNVEIERVMITDEEEIRTTNPVATEQYGSVSTNLQAGNAQAATADVN

SEQ ID NO: 3085 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGPATKSALGFSQAGASDIRDQSRNWLPGPCYRQQRVSKTDGENNNSDFSWTGATKYHLNGRDSLVNPGPAMASHKDDEEKFFPQSGVLIFGKEGDRKSNVEVGEVMITDEEEIRTTNPVATEQYGSVSTNLQAGNAQAATADVN

SEQ ID NO: 3086 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSTKSNENNNSDFSWTGATKYHLNGRDSLVNPGPAMASHKDDEEKFFPQSGVLIFGKQNSAETNVEIDGVMITDEEEIRTTNPVATEQYGSVSTNLQAGNAQAATADVN

SEQ ID NO: 3087 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATTYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3088 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSTDNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3089 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKENSKANNVDIGGVMITDEEEIRTTNPVATEQYGSVSTNLQAGNAQAATADVN

SEQ ID NO: 3090 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDRFFPQSGVLIFGKEDAGKTNIDIGQVMITDEEEIRTTNPVATEQYGSVSTNLQRGNRQAATADVN

SEQ ID NO: 3091 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDDDRFFPQSGVLIFGKHGSEKTNVDIEKVMITDEEEIRTTNPVATEQYGSVSTNLQRGNRQAATADVN

SEQ ID NO: 3092 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGTAGNNVAIENVMITDEEEIRTTNPVATEQYGSVSTNLQAGNAQAATADVN

SEQ ID NO: 3093 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSSRANVAIGGVMITDEEEIRTTNPVATEQYGSVSTNLQAGNAQAATADVN

SEQ ID NO: 3094 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNKTPSPLNFSQAGASDIRDQSRNWLPGPCYRQQRVSKQSSDNNNSEFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 3095 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPGDNNNSNFSWTGATKYHLNGRDSLVNPGPAMASHKDDDDKFFPQSGVLIFGKEGGGATDVEIEGVMITDEEEIRTTNPVATEQYGSVSTNLQAGNAQAATADVN

SEQ ID NO: 3096 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGLHTTSRLRFSQAGASDIRDQSRNWLPGPCYRQQRVSKQSSDNNNSEFSWTGATTYHLNGRDSLVNPGPAMASHRDDEDKFFPQSGVLIFGKEGGRGANVAVEEVMITDEEEIRTTNPVATEQYGSVSTNLQAGNAQAATADVN

SEQ ID NO: 3097 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKQNAGKDDVDIDQVMITDEEEIRTTNPVATEQYGSVSTNLQAGNAQAATADVN

SEQ ID NO: 3098 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGHETLSGLRFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 3099 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKASDNNNSNFSWTGATTYHLNGRDSLVNPGPAMASHKDDAGKFFPQSGVLIFGKQGSEKTNVDIEKVMITDEEEIRTTNPVATEQYGSVSTNLQAGNAQAATADVN

SEQ ID NO: 3100 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWPGATTYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 3101 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3102 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTPSALKFSQAGASDIRDQSRNWLPGPCYRQQRVSTTPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3103 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKYDEEKFFPQSGVLIFGKQGSEKTNVDIEKVMITDEEEIRTTNPVATEQYGSVSTNLQKHNSSAASGNVT

SEQ ID NO: 3104 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKEGGDKANVEIGQVMITDEEEIRTTNPVATEQYGSVSTNLQAGNAQAATADVN

SEQ ID NO: 3105 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTAGQNNNSNFSWTGATKYHLNGRDSLVNPGPAMASHKDDEEKFFPQSGVLIFGKQGAGKDDIAIDNVMITDEEEIRTTNPVATEQYGSVSTNLQAGNAQAATADVN

SEQ ID NO: 3106 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGAAGSDIEIEEVMITDEEEIRTTNPVATEQYGSVSTNLQAGNAQAATADVN

SEQ ID NO: 3107 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHKDDADKFFPQSGVLIFGKEGGNGSNVDIGRVMITDEEEIRTTNPVATEQYGSVSTNLQAGNAQAATADVN

SEQ ID NO: 3108 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDAGAANVEFGQVMITDEEEIRTTNPVATEQYGSVSTNLQAGNAQAATADVN

SEQ ID NO: 3109 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAGGTLTHSRLKFSQAGASDIRDQSRNWLPGPCYRQQRVSTTPNENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 3110 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 3111 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSRRNDVDIDRVMITDEEEIRTTNPVATEQYGSVSTNLQAGNAQAATADVN

SEQ ID NO: 3112 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 3113 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDKFFPQSGVLIFGKQSASKNNIAIEEVMITDEEEIRTTNPVATEQYGSVSTNLQAGNAQAATADVN

SEQ ID NO: 3114 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNDNSEYSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 3115 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSDFSWTGATKYHLNGRDSLVNPGPAMASHKDDDERFFPQSGVLIFGKQGSEKTNVDIEKVMITDEEEIRTTNPVATEQYGSVSTNLQRGNRQAATADVN

SEQ ID NO: 3116 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHEDDKGKFFPQSGVLIFGKQGSEKTNVDIEKVMITDEEEIRTTNPVATEQYGSVSTNLQAGNAQAATADVN

SEQ ID NO: 3117 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKEGADRADVAIEGVMITDEEEIRTTNPVATEQYGSVSTNLQAGNAQAATADVN

SEQ ID NO: 3118 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSDSGRTTPSTLLFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3119 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSELRFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3120 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKQSDRNNNSEFSWTGATKYHLNGRDSLVNPGPAMASHKDDEDKFFPQSGVLIFGKQDAGATDVAIGEVMITDEEEIRTTNPVATEQYGSVSTNLQAGNAQAATADVN

SEQ ID NO: 3121 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTSADNNNSEFSWPGATKYHLNGRDSLVNPGPAMASHRDDEEKFFPQSGVLIFGKQGSEKTNVDIEKVMITDEEEIRTTNPVATEQYGSVSTNLQRGNRQAATADVN

SEQ ID NO: 3122 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 3123 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGRFFPQSGVLIFGKEGAKKNNVAFDGVMITDEEEIRTTNPVATEQYGSVSTNLQAGNAQAATADVN

SEQ ID NO: 3124 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSSRNGAATDVVQ

SEQ ID NO: 3125 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGRLTTSKLNFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3126 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAERANIEIDKVMITDEEEIRTTNPVATEQYGSVSTNLQAGNAQAATADVN

SEQ ID NO: 3127 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGTSKDNVAFDQVMITDEEEIRTTNPVATEQYGSVSTNLQAGNAQAATADVN

SEQ ID NO: 3128 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGERTGAASRAVE

SEQ ID NO: 3129 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQANRSQAATRDVH

SEQ ID NO: 3130 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRGRAAYEDVN

SEQ ID NO: 3131 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSNFSWTGATKYHLNGRDSLVNPGPAMASHKDDADKFFPQSGVLIFGKEGAGETNVEIENVMITDEEEIRTTNPVATEQYGSVSTNLQAGNAQAATADVN

SEQ ID NO: 3132 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSAASNADVGQVMITDEEEIRTTNPVATEQYGSVSTNLQAGNAQAATADVN

SEQ ID NO: 3133 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGKNSAAIADVQ

SEQ ID NO: 3134 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSSGGIITHSDLRFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3135 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDEGGSITLSRLLFSQAGASDIRDQSRNWLPGPCYRQQRVSKTDGENNNSDFSWTGATKYHLNGRDSLVNPGPAMASHKDDEEKFFPQSGVLIFGKQSAKAANAAIDEVMITDEEEIRTTNPVATEQYGSVSTNLQAGNAQAATADVN

SEQ ID NO: 3136 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTTPTGNNNSDFSWTGATKYHLNGRDSLVNPGPAMASHKDDDDRFFPQSGVLIFGKQSAKAANAAIDEVMITDEEEIRTTNPVATEQYGSVSTNLQRGNRQAATADVN

SEQ ID NO: 3137 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPKNPAAADMVT

SEQ ID NO: 3138 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSEYSWTGATKYHLNGRDSLVNPGPAMASHKDDNDRFFPQSGVLIFGKQGAKGTNVAVEKVMITDEEEIRTTNPVATEQYGSVSTNLQAGNAQAATADVN

SEQ ID NO: 3139 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHSGIDTKSRLVFSQAGASDIRDQSRNWLPGPCYRQQRVSTQSTGNNNSDFSWTGATKYHLNGRDSLVNPGPAMASHKDDDDRFFPQSGVLIFGKENAGGGNVDYDQVMITDEEEIRTTNPVATEQYGSVSTNLQAGNAQAATADVN

SEQ ID NO: 3140 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGTVTTSHLRFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3141 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKQDTDNNNSDFSWTGATKYHLNGRDSLVNPGPAMASHGDDDGKFFPQSGVLIFGKQGSEKTNVDIEKVMITDEEEIRTTNPVATEQYGSVSTNLQAGNAQAATADVN

SEQ ID NO: 3142 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQGGNQTQSALRFSQAGASDIRDQSRNWLPGPCYRQQRVSKKDSRNNNSDFSWTGATKYHLNGRDSLVNPGPAMASHKDDEDKFFPQSGVLIFGKEGAKKSDVAYDEVMITDEEEIRTTNPVATEQYGSVSTNLQRGNRQAATADVN

SEQ ID NO: 3143 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 3144 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWPGATKYHLNGRDSLVNPGPAMASHKDDEEKFFPQSGVLIFGKQGTRRDNADFDGVMITDEEEIRTTNPVATEQYGSVSTNLQAGNAQAATADVN

SEQ ID NO: 3145 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGTITHSSLRFSQAGASDIRDQSRNWLPGPCYRQQRVSKQSSDNNNSEFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 3146 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 3147 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGSTTLSGLRFSQAGASDIRDQSRNWLPGPCYRQQRVSKTSADNNNSEYSWTGATKYHLNGRDSLVNPGPAMASHKDDEEKFFPQSGVLIFGKQDGNASNVDIDRVMITDEEEIRTTNPVATEQYGSVSTNLQAGNAQAATADVN

SEQ ID NO: 3148 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3149 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 3150 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTAAQNNNSDFSWTGATKYHLNGRDSLVNPGPAMASHKDDDDRFFPQSGVLIFGKQGAGKNNAAIGQVMITDEEEIRTTNPVATEQYGSVSTNLQAGNAQAATADVN

SEQ ID NO: 3151 - protein, 334 aa, Artificial Sequence
  Synthetic
KAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDEEKFFPQSGVLIFGKQGARAANIDIGQVMITDEEEIRTTNPVATEQYGSVSTNLQAGNAQAATADVN

SEQ ID NO: 3152 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSHSGPVTLSGLGFSQAGASDIRDQSRNWLPGPCYRQQRVSKQDTDNNNSDFSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 3153 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3154 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDDGNNNSDFSWTGATTYHLNGRDSLVNPGPAMASHKDDEGRFFPQSGVLIFGKESGGENNAEIEHVMITDEEEIRTTNPVATEQYGSVSTNLQAGNAQAATADVN

SEQ ID NO: 3155 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGGTTGNVDIGRVMITDEEEIRTTNPVATEQYGSVSTNLQAGNAQAATADVN

SEQ ID NO: 3156 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKENGTASDVAFEEVMITDEEEIRTTNPVATEQYGSVSTNLQAGNAQAATADVN

SEQ ID NO: 3157 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKESGGKGNVEIEQVMITDEEEIRTTNPVATEQYGSVSTNLQAGNAQAATADVN

SEQ ID NO: 3158 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGTGKDNVAIGGVMITDEEEIRTTNPVATEQYGSVSTNLQAGNAQAATADVN

SEQ ID NO: 3159 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSNRGNIAIDEVMITDEEEIRTTNPVATEQYGSVSTNLQAGNAQAATADVN

SEQ ID NO: 3160 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTSADNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3161 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQLGDNNNSNFSWTGATKYHLNGRDSLVNPGPAMASHKDDDDKFFPQSGVLIFGKQDARAADADIEQVMITDEEEIRTTNPVATEQYGSVSTNLQAGNAQAATADVN

SEQ ID NO: 3162 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDEKFFPQSGVLIFGKQSGTKGDVAVGEVMITDEEEIRTTNPVATEQYGSVSTNLQAGNAQAATADVN

SEQ ID NO: 3163 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKGGSTTTSPLKFSQAGASDIRDQSRNWLPGPCYRQQRVSKTSADNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3164 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNATTSRLMFSQAGASDIRDQSRNWLPGPCYRQQRVSKTSADNNNSEYSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 3165 - protein, 334 aa, Artificial Sequence; identical to SEQ ID NO: 272
  Synthetic

SEQ ID NO: 3166 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKQPGDNNNSNFSWTGATKYHLNGRDSLVNPGPAMASHKDDEEKFFPQSGVLIFGKQGATAANVAVDNVMITDEEEIRTTNPVATEQYGSVSTNLQAGNAQAATADVN

SEQ ID NO: 3167 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEDAGKTNIDIGQVMITDEEEIRTTNPVATEQYGSVSTNLQAGNAQAATADVN

SEQ ID NO: 3168 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAHNNAAFDVVA

SEQ ID NO: 3169 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQGRKTGAAAEVVA

SEQ ID NO: 3170 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSANNNNSEYSWTGATKYHLNGRDSLVNPGPAMASHRDDNDRFFPQSGVLIFGKEGAGKTDVAIGRVMITDEEEIRTTNPVATEQYGSVSTNLQAGNAQAATADVN

SEQ ID NO: 3171 - protein, 334 aa, Artificial Sequence
  Synthetic
KAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSKQASDNNNSNFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 3172 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQNAGASDADFDQVMITDEEEIRTTNPVATEQYGSVSTNLQAGNAQAATADVN

SEQ ID NO: 3173 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNATTSRLMFSQAGASDIRDQSRNWLPGPCYRQQRVSKQSGQNNNSDFSWTGATKYHLNGRDSLVNPGPAMASHKDDDDRFFPQSGVLIFGKEGTGANNAEIGEVMITDEEEIRTTNPVATEQYGSVSTNLQAGNAQAATADVN

SEQ ID NO: 3174 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNTTQSRLHFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 3175 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDAENNNSDFSWTGATKYHLNGRDSLVNPGPAMASHKDDDDRFFPQSGVLIFGKESSAKSNVEFDSVMITDEEEIRTTNPVATEQYGSVSTNLQAGNAQAATADVN

SEQ ID NO: 3176 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNATKANADFGDVMITDEEEIRTTNPVATEQYGSVSTNLQAGNAQAATADVN

SEQ ID NO: 3177 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSQTKSELQFSQAGASDIRDQSRNWLPGPCYRQQRVSKKYTDNNNSNFSWTGATTYHLNGRDSLVNPGPAMASHEDDTDKFFPQSGVLIFGKQGSEKTNVDIEKVMITDEEEIRTTNPVATEQYGSVSTNLQAGNAQAATADVN

SEQ ID NO: 3178 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARAGLTTLSQLGFSQAGASDIRDQSRNWLPGPCYRQQRVSKTDGENNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3179 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKENGGGANIDIGQVMITDEEEIRTTNPVATEQYGSVSTNLQAGNAQAATADVN

SEQ ID NO: 3180 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 3181 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGPVTPSNLRFSQAGASDIRDQSRNWLPGPCYRQQRVSKQDTDNNNSDFSWTGATKYHLNGRDSLVNPGPAMASHGDDDGKFFPQSGVLIFGKQGAGKTDIAFEGVMITDEEEIRTTNPVATEQYGSVSTNLQAGNAQAATADVN

SEQ ID NO: 3182 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKEGGGRGDVDIEGVMITDEEEIRTTNPVATEQYGSVSTNLQAGNAQAATADVN

SEQ ID NO: 3183 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGAGKDDVDIGGVMITDEEEIRTTNPVATEQYGSVSTNLQAGNAQAATADVN

SEQ ID NO: 3184 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSMTMSTLKFSQAGASDIRDQSRNWLPGPCYRQQRVSKQASDNNNSEFSWTGATKYHLNGRDSLVNPGPAMASHKDDEEKFFPQSGVLIFGKEGSEKNDVEFEQVMITDEEEIRTTNPVATEQYGSVSTNLQAGNAQAATADVN

SEQ ID NO: 3185 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEDKFFPQSGVLIFGKQNGSTTNVDIGGVMITDEEEIRTTNPVATEQYGSVSTNLQAGNAQAATADVN

SEQ ID NO: 3186 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKVSADNNNSEFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 3187 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGPVTPSNLRFSQAGASDIRDQSRNWLPGPCYRQQRVSKTAGRNNNSDFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3188 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3189 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGTGTANAEVGEVMITDEEEIRTTNPVATEQYGSVSTNLQAGNAQAATADVN

SEQ ID NO: 3190 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKQDSTRTNAAIEQVMITDEEEIRTTNPVATEQYGSVSTNLQAGNAQAATADVN

SEQ ID NO: 3191 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 3192 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARAGLTTLSQLKFSQAGASDIRDQSRNWLPGPCYRQQRVSKQHNQNNNSEFSWTGATTYHLNGRDSLVNPGPAMASHKDDDEKFFPQSGVLIFGKEGAGKGDVEYEKVMITDEEEIRTTNPVATEQYGSVSTNLQAGNAQAATADVN

SEQ ID NO: 3193 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDNDRFFPQSGVLIFGKEGAGAANVEIDRVMITDEEEIRTTNPVATEQYGSVSTNLQAGNAQAATADVN

SEQ ID NO: 3194 - protein, 334 aa, Artificial Sequence
  Synthetic
KAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEESFFPQSGVLIFGKEGASKANTAVEHVMITDEEEIRTTNPVATEQYGSVSTNLQAGNAQAATADVN

SEQ ID NO: 3195 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGRATNSELRFSQAGASDIRDQSRNWLPGPCYRQQRVSKQDTDNNNSEFSWTGATTYHLNGRDSLVNPGPAMASHKDDDEKFFPQSGVLIFGKEDAGTTNVAFDKVMITDEEEIRTTNPVATEQYGSVSTNLQAGNAQAATADVN

SEQ ID NO: 3196 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGHMTLSGLRFSQAGASDIRDQSRNWLPGPCYRQQRVSKTSTENNNSNFSWTGATTYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 3197 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKEDGDGANVAIDRVMITDEEEIRTTNPVATEQYGSVSTNLQAGNAQAATADVN

SEQ ID NO: 3198 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGSETNSPLHFSQAGASDIRDQSRNWLPGPCYRQQRVSKVSADNNNSEFSWTGATKYHLNGRDSLVNPGPAMASHKDDEEKFFPQSGVLIFGKEDAGKTNIDIGQVMITDEEEIRTTNPVATEQYGSVSTNLQAGNTQAATADVN

SEQ ID NO: 3199 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKQGATRSNIDIGNVMITDEEEIRTTNPVATEQYGSVSTNLQAGNAQAATADVN

SEQ ID NO: 3200 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKESAAGDNIEIGDVMITDEEEIRTTNPVATEQYGSVSTNLQAGNAQAATADVN

SEQ ID NO: 3201 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSEKTNVDIEKVMITDEEEIRTTNPVATEQYGSVSTNLQEGNAQAATADVN

SEQ ID NO: 3202 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGASKTNIDIGKVMITDEEEIRTTNPVATEQYGSVSTNLQAGNAQAATADVN

SEQ ID NO: 3203 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNAKTRAAFTTVD

SEQ ID NO: 3204 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQDTGGANIDIGQVMITDEEEIRTTNPVATEQYGSVSTNLQAGNAQAATADVN

SEQ ID NO: 3205 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDESGPKTLSALRFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3206 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDRFFPQSGVLIFGKQGSEKTNVDIEKVMITDEEEIRTTNPVATEQYGSVSTNLQRGNRQAATADVN

SEQ ID NO: 3207 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKTGLVTMSTLGFSQAGASDIRDQSRNWLPGPCYRQQRVSKKSTGNNNSDFSWTGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 3208 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDTDNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3209 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEGTEKSNVAIERVMITDEEEIRTTNPVATEQYGSVSTNLQAGNAQAATADVN

SEQ ID NO: 3210 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGITTKSRLQFSQAGASDIRDQSRNWLPGPCYRQQRVSKQSDRNNNSEFSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 3211 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATKYHLNGRDSLVNPGPAMASHKDDEDKFFPQSGVLIFGKEDGGRGNVDVEDVMITDEEEIRTTNPVATEQYGSVSTNLQRGNRQAATADVN

SEQ ID NO: 3212 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHGDDNDRFFPQSGVLIFGKQGSEKTNVDIEKVMITDEEEIRTTNPVATEQYGSVSTNLQRGNRQAATADVN

SEQ ID NO: 3213 - protein, 334 aa, Artificial Sequence; identical to SEQ ID NO: 374
  Synthetic

SEQ ID NO: 3214 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDGERANVDVERVMITDEEEIRTTNPVATEQYGSVSTNLQAGNAQAATADVN

SEQ ID NO: 3215 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGHPTKSRLVFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3216 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGHKTTSRLGFSQAGASDIRDQSRNWLPGPCYRQQRVSKVSADNNNSEFSWTGATKYHLNGRDSLVNPGPAMASHKDDEDKFFPQSGVLIFGKEGTEKSNVAIERVMITDEEEIRTTNPVATEQYGSVSTNLQAGNAQAATADVN

SEQ ID NO: 3217 - protein, 334 aa, Artificial Sequence
  Synthetic
ESGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQGGSNTKSGLKFSQAGASDIRDQSRNWLPGPCYRQQRVSKTDGENNNSDFSWTGATKYHLNGRDSLVNPGPAMASHKDDEEKFFPQSGVLIFGKEGAGETNVEIENVMITDEEEIRTTNPVATEQYGSVSTNLQAGNAQAATADVN

SEQ ID NO: 3218 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSNFSWTGATKYHLNGRDSLVNPGPAMASHKDDDDRFFPQSGVLIFGKEGAGGTDIDIGHVMITDEEEIRTTNPVATEQYGSVSTNLQAGNAQAATADVN

SEQ ID NO: 3219 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEYSWTGATKYHLNGRDSLVNPGPAMASHKDDEEKFFPQSGVLIFGKEDSGGTNVEIGRVMITDEEEIRTTNPVATEQYGSVSTNLQAGNAQAATADVN

SEQ ID NO: 3220 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGNHTISQLGFSQAGASDIRDQSRNWLPGPCYRQQRVSKQASDNNNSEFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 3221 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGKSGHAAAREVA

SEQ ID NO: 3222 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNEKFFPQSGVLIFGKEGAGTNDIDIERVMITDEEEIRTTNPVATEQYGSVSTNLQAGNAQAATADVN

SEQ ID NO: 3223 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPSENNNSDFSWTGATTYHLNGRDSLVNPGPAMASHRDDEDRFFPQSGVLIFGKEGAGKADIEIGKVMITDEEEIRTTNPVATEQYGSVSTNLQAGNAQAATADVN

SEQ ID NO: 3224 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQDTSANDVAIDEVMITDEEEIRTTNPVATEQYGSVSTNLQAGNAQAATADVN

SEQ ID NO: 3225 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARSGSLTQSHLGFSQAGASDIRDQSRNWLPGPCYRQQRVSKQSDRNNNSEFSWTGATKYHLNGRDSLVNPGPAMASHKDDEDKFFPQSGVLIFGKQGAATDNAAIDQVMITDEEEIRTTNPVATEQYGSVSTNLQAGNAQAATADVN

SEQ ID NO: 3226 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 3227 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHGDDAERFFPQSGVLIFGKQGSEKTNVDIEKVMITDEEEIRTTNPVATEQYGSVSTNLQAGNAQAATADVN

SEQ ID NO: 3228 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKATDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3229 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDATGTLTISNLRFSQAGASDIRDQSRNWLPGPCYRQQRVSTTADGNNNSNFSWTGATTYHLNGRDSLVNPGPAMASHRDDNEKFFPQSGVLIFGKQGSEKTNVDIEKVMITDEEEIRTTNPVATEQYGSVSTNLQAGNAQAATADVN

SEQ ID NO: 3230 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTTSTLQFSQAGASDIRDQSRNWLPGPCYRQQRVSKKSTDNNNSEFSWTGATKYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 3231 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEGTEKSNVAIERVMITDEEEIRTTNPVATEQYGSVSTNLQAGNAQAATADVN

SEQ ID NO: 3232 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQNATKNDVAFGEVMITDEEEIRTTNPVATEQYGSVSTNLQAGNAQAATADVN

SEQ ID NO: 3233 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSTTAAQNNNSDFSWTGATKYHLNGRDSLVNPGPAMASHGDDAERFFPQSGVLIFGKQGSEKTNVDIEKVMITDEEEIRTTNPVATEQYGSVSTNLQAGNAQAATADVN

SEQ ID NO: 3234 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3235 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRSGAAVRDVH

SEQ ID NO: 3236 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSETGNNTPSHLLFSQAGASDIRDQSRNWLPGPCYRQQRVSKQSDRNNNSEFSWTGATKYHLNGRDSLVNPGPAMASHKDDEDKFFPQSGVLIFGKEGANGTNVEIGKVMITDEEEIRTTNPVATEQYGSVSTNLQAGNAQAATADVN

SEQ ID NO: 3237 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKEGTGRANVAIERVMITDEEEIRTTNPVATEQYGSVSTNLQAGNAQAATADVN

SEQ ID NO: 3238 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGGNNNSEFSWTGATTYHLNGRDSLVNPGPAMASHKDDEEKFFPQSGVLIFGKESSTRSDIDFDHVMITDEEEIRTTNPVATEQYGSVSTNLQAGNAQAATADVN

SEQ ID NO: 3239 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRRDPAANDGVN

SEQ ID NO: 3240 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGRTTPSTLLFSQAGASDIRDQSRNWLPGPCYRQQRVSKTSDGNNNSDFSWTGATKYHLNGRDSLVNPGPAMASHEDDKDKFFPQSGVLIFGKQGSEKTNVDIEKVMITDEEEIRTTNPVATEQYGSVSTNLQAGNAQAATADVN

SEQ ID NO: 3241 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTAGDNNNSNFSWTGATTYHLNGRDSLVNPGPAMASHRDDEDKFFPQSGVLIFGKQSSGKSNIAIEGVMITDEEEIRTTNPVATEQYGSVSTNLQAGNAQAATADVN

SEQ ID NO: 3242 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKTSADNNNSEFSWTGATTYHLNGRDSLVNPGPAMASHKDDNDKFFPQSGVLIFGKQGSGTSNVEFEQVMITDEEEIRTTNPVATEQYGSVSTNLQAGNAQAATADVN

SEQ ID NO: 3243 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3244 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTADHNNNSDFSWTGATKYHLNGRDSLVNPGPAMASHKDDEEKFFPQSGVLIFGKENAGASDIAIDHVMITDEEEIRTTNPVATEQYGSVSTNLQAGNAQAATADVN

SEQ ID NO: 3245 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDDDKFFPQSGVLIFGKQGSEKTNVDIEKVMITDEEEIRTTNPVATEQYGSVSTNLQRGNRQAATADVN

SEQ ID NO: 3246 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTERTGAAFDEVD

SEQ ID NO: 3247 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRSGSLTHSDLRFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 3248 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTQSGTTTQSRLQFSQAGASDIRDQSRNWLPGPCYRQQRVSKQSDHNNNSNFSWTGATKYHLNGRDSLVNPGPAMASHKDDDDKFFPQSGVLIFGKEGGGASDVDIESVMITDEEEIRTTNPVATEQYGSVSTNLQAGNAQAATADVN

SEQ ID NO: 3249 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGADGANVAYDRVMITDEEEIRTTNPVATEQYGSVSTNLQAGNAQAATADVN

SEQ ID NO: 3250 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAARSGAASEGVD

SEQ ID NO: 3251 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 3252 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDGNAANVDIERVMITDEEEIRTTNPVATEQYGSVSTNLQAGNAQAATADVN

SEQ ID NO: 3253 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTDGENNNSDFSWTGATKYHLNGRDSLVNPGPAMASHKDDEEKFFPQSGVLIFGKEDARGADAEIGEVMITDEEEIRTTNPVATEQYGSVSTNLQAGNAQAATADVN

SEQ ID NO: 3254 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGSSAGAAAQVVQ

SEQ ID NO: 3255 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEYSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 3256 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAEGTNADIENVMITDEEEIRTTNPVATEQYGSVSTNLQAGNAQAATADVN

SEQ ID NO: 3257 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQANKDHAAYTTVD

SEQ ID NO: 3258 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTSGPNTISRLEFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 3259 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGSATKSALRFSQAGASDIRDQSRNWLPGPCYRQQRVSTKHGGNNNSNFSWTGATKYHLNGRDSLVNPGPAMASHRDDDDRFFPQSGVLIFGKQGSEKTNVDIEKVMITDEEEIRTTNPVATEQYGSVSTNLQAGNAQAATADVN

SEQ ID NO: 3260 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDDRFFPQSGVLIFGKESGDKANVAVDEVMITDEEEIRTTNPVATEQYGSVSTNLQAGNAQAATADVN

SEQ ID NO: 3261 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKSNENNNSDFSWTGATTYHLNGRDSLVNPGPAMASHRDDDEKFFPQSGVLIFGKQGSSAGNVDIDRVMITDEEEIRTTNPVATEQYGSVSTNLQAGNAQAATADVN

SEQ ID NO: 3262 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKQNGGKNDVDIEQVMITDEEEIRTTNPVATEQYGSVSTNLQAGNAQAATADVN

SEQ ID NO: 3263 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDTRTAAAIRTVN

SEQ ID NO: 3264 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDAAGIKTTSQLNFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 3265 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 3266 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKESAKTTDTDVDGVMITDEEEIRTTNPVATEQYGSVSTNLQAGNAQAATADVN

SEQ ID NO: 3267 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHEDDADKFFPQSGVLIFGKQGATESDVDFDQVMITDEEEIRTTNPVATEQYGSVSTNLQAGNAQAATADVN

SEQ ID NO: 3268 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPGGNNNSEYSWTGATKYHLNGRDSLVNPGPAMASHGDDNDRFFPQSGVLIFGKQDSTKANADIEGVMITDEEEIRTTNPVATEQYGSVSTNLQAGNAQAATADVN

SEQ ID NO: 3269 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQPTGNNNSEFSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 3270 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENGDKTNVEIDRVMITDEEEIRTTNPVATEQYGSVSTNLQAGNAQAATADVN

SEQ ID NO: 3271 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKESAEKSNAAIERVMITDEEEIRTTNPVATEQYGSVSTNLQAGNAQAATADVN

SEQ ID NO: 3272 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEHRNTAASREVE

SEQ ID NO: 3273 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTSGTTTKSALRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3274 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKEGAKENNADIDEVMITDEEEIRTTNPVATEQYGSVSTNLQAGNAQAATADVN

SEQ ID NO: 3275 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQGPRAGAAVEDVD

SEQ ID NO: 3276 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTQSTQNNNSDFSWTGATKYHLNGRDSLVNPGPAMASHRDDEDKFFPQSGVLIFGKEGAGTNDVAVEHVMITDEEEIRTTNPVATEQYGSVSTNLQAGNAQAATADVN

SEQ ID NO: 3277 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKHGGNNNSNFSWTGATTYHLNGRDSLVNPGPAMASHKDDDDRFFPQSGVLIFGKQSSGKTDVDFGGVMITDEEEIRTTNPVATEQYGSVSTNLQRGNRQAATADVN

SEQ ID NO: 3278 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNEKFFPQSGVLIFGKQSTSRGDVDIGGVMITDEEEIRTTNPVATEQYGSVSTNLQAGNAQAATADVN

SEQ ID NO: 3279 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 3280 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDKFFPQSGVLIFGKESSAATNAAIEQVMITDEEEIRTTNPVATEQYGSVSTNLQAGNAQAATADVN

SEQ ID NO: 3281 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNVTNSSLRFSQAGASDIRDQSRNWLPGPCYRQQRVSKTYNDNNNSEFSWTGATTYHLNGRDSLVNPGPAMASHRDDEGKFFPQSGVLIFGKQGSEKTNVDIEKVMITDEEEIRTTNPVATEQYGSVSTNLQAGNAQAATADVN

SEQ ID NO: 3282 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKVSADNNNSEFSWTGATKYHLNGRDSLVNPGPAMASHKDDEEKFFPQSGVLIFGKQNATEGDIDIGGVMITDEEEIRTTNPVATEQYGSVSTNLQAGNAQAATADVN

SEQ ID NO: 3283 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQNTAGNDVDIERVMITDEEEIRTTNPVATEQYGSVSTNLQAGNAQAATADVN

SEQ ID NO: 3284 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSGKNNADIEKVMITDEEEIRTTNPVATEQYGSVSTNLQAGNAQAATADVN

SEQ ID NO: 3285 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3286 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 3287 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKQDGGTANVEYEQVMITDEEEIRTTNPVATEQYGSVSTNLQAGNAQAATADVN

SEQ ID NO: 3288 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNSGNHTLSPLSFSQAGASDIRDQSRNWLPGPCYRQQRVSKTPNGNNNSDFSWTGATKYHLNGRDSLVNPGPAMASHKDDDDRFFPQSGVLIFGKEGAGGNNVEIDDVMITDEEEIRTTNPVATEQYGSVSTNLQAGNAQAATADVN

SEQ ID NO: 3289 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSAHNNNSNFSWTGATKYHLNGRDSLVNPGPAMASHKDDEEKFFPQSGVLIFGKEGANGTNVEIGKVMITDEEEIRTTNPVATEQYGSVSTNLQAGNAQAATADVN

SEQ ID NO: 3290 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASGGSVTISSLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3291 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDTDNNNSNFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 3292 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGIMTTSTLRFSQAGASDIRDQSRNWLPGPCYRQQRVSKTSADNNNSNFSWTGATKYHLNGRDSLVNPGPAMASHRDDEDKFFPQSGVLIFGKEDAARTDVAIDKVMITDEEEIRTTNPVATEQYGSVSTNLQAGNAQAATADVN

SEQ ID NO: 3293 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEGSRKNNAEFGEVMITDEEEIRTTNPVATEQYGSVSTNLQAGNAQAATADVN

SEQ ID NO: 3294 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGTVTTSHLRFSQAGASDIRDQSRNWLPGPCYRQQRVSTTPADNNNSDFSWTGATKYHLNGRDSLVNPGPAMASHKDDDEKFFPQSGVLIFGKQNSGATDVAIGGVMITDEEEIRTTNPVATEQYGSVSTNLQAGNAQAATADVN

SEQ ID NO: 3295 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKQPSQNNNSNFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3296 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGNTTMSRLGFSQAGASDIRDQSRNWLPGPCYRQQRVSTTYNHNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3297 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPSQNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3298 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSDFSWTGATKYHLNGRDSLVNPGPAMASHKDDTEKFFPQSGVLIFGKQGSEKTNVDIEKVMITDEEEIRTTNPVATEQYGSVSTNLQAGNAQAATADVN

SEQ ID NO: 3299 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKTDGENNNSDFSWTGATKYHLNGRDSLVNPGPAMASHKDDEEKFFPQSGVLIFGKESGEGNNVEVDRVMITDEEEIRTTNPVATEQYGSVSTNLQAGNAQAATADVN

SEQ ID NO: 3300 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQSSDNNNSEFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 3301 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKEGSEKTNVDIEKVMITDEEEIRTTNPVATEQYGSVSTNLQAGNAQAATADVN

SEQ ID NO: 3302 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDKFFPQSGVLIFGKESATGNNVAIDNVMITDEEEIRTTNPVATEQYGSVSTNLQAGNAQAATADVN

SEQ ID NO: 3303 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRAGLATQSRLGFSQAGASDIRDQSRNWLPGPCYRQQRVSKTSADNNNSEFSWTGATTYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 3304 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHKDDEEKFFPQSGVLIFGKEDAAKSNVEVERVMITDEEEIRTTNPVATEQYGSVSTNLQAGNAQAATADVN

SEQ ID NO: 3305 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSTQSTHNNNSDFSWTGATKYHLNGRDSLVNPGPAMASHKDDEDKFFPQSGVLIFGKEGAGAANVEIDRVMITDEEEIRTTNPVATEQYGSVSTNLQAGNAQAATADVN

SEQ ID NO: 3306 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSETHGDNNNSNFSWTGATTYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 3307 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGKGSAATARVE

SEQ ID NO: 3308 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 3309 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAGGTLTHSRLKFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3310 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGTPTHSTLKFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3311 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEDGNGSDTDIDSVMITDEEEIRTTNPVATEQYGSVSTNLQAGNAQAATADVN

SEQ ID NO: 3312 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSKTDGENNNSDFSWTGATKYHLNGRDSLVNPGPAMASHKDDEEKFFPQSGVLIFGKEGSEGANAAIEEVMITDEEEIRTTNPVATEQYGSVSTNLQAGNAQAATADVN

SEQ ID NO: 3313 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARSGLTTPSDLKFSQAGASDIRDQSRNWLPGPCYRQQRVSKQPNDNNNSEFSWTGATTYHLNGRDSLVNPGPAMASHKDDNEKFFPQSGVLIFGKEDGKGANVDIGEVMITDEEEIRTTNPVATEQYGSVSTNLQAGNAQAATADVN

SEQ ID NO: 3314 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3315 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQIGLNTLSDLRFSQAGASDIRDQSRNWLPGPCYRQQRVSKQPGDNNNSNFSWTGATKYHLNGRDSLVNPGPAMASHKDDDDRFFPQSGVLIFGKQDASGDDVEVDKVMITDEEEIRTTNPVATEQYGSVSTNLQAGNAQAATADVN

SEQ ID NO: 3316 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPNENNNSDFSWTGATKYHLNGRDSLVNPGPAMASHRDDEDKFFPQSGVLIFGKQGATRSNIDIGNVMITDEEEIRTTNPVATEQYGSVSTNLQAGNAQAATADVN

SEQ ID NO: 3317 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPHSQAAFQSVD

SEQ ID NO: 3318 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTHGDNNNSNFSWTGATTYHLNGRDSLVNPGPAMASHRDDADRFFPQSGVLIFGKQGSEKTNVDIEKVMITDEEEIRTTNPVATEQYGSVSTNLQAGNAQAATADVN

SEQ ID NO: 3319 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3320 - protein, 334 aa, Artificial Sequence; identical to SEQ ID NO: 53
  Synthetic

SEQ ID NO: 3321 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNATGRDTMSTLKFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3322 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKQGSEKTNVDIEKVMITDEEEIRTTNPVATEQYGSVSTNLQAGNRQAATADVN

SEQ ID NO: 3323 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 3324 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAKGGPTTHSPLRFSQAGASDIRDQSRNWLPGPCYRQQRVSKQANHNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3325 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKEGSEKTNVDIEKVMITDEEEIRTTNPVATEQYGSVSTNLQAGNAQAATADVN

SEQ ID NO: 3326 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNKTMSRLQFSQAGASDIRDQSRNWLPGPCYRQQRVSKTSADNNNSEYSWTGATKYHLNGRDSLVNPGPAMASHKDDEGRFFPQSGVLIFGKQGSEKTNVDIEKVMITDEEEIRTTNPVATEQYGSVSTNLQRGNRQAATADVN

SEQ ID NO: 3327 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSHGGIITKSGLRFSQAGASDIRDQSRNWLPGPCYRQQRVSKTHGDNNNSNFSWTGATTYHLNGRDSLVNPGPAMASHRDDEDKFFPQSGVLIFGKESAKKTDVEIENVMITDEEEIRTTNPVATEQYGSVSTNLQAGNAQAATADVN

SEQ ID NO: 3328 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSKTHDGNNNSEFSWTGATKYHLNGRDSLVNPGPAMASHRDDEDKFFPQSGVLIFGKEGGAGADVDIGQVMITDEEEIRTTNPVATEQYGSVSTNLQAGNAQAATADVN

SEQ ID NO: 3329 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQDSGAGNTDIEGVMITDEEEIRTTNPVATEQYGSVSTNLQAGNAQAATADVN

SEQ ID NO: 3330 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTSTSNADVGEVMITDEEEIRTTNPVATEQYGSVSTNLQAGNAQAATADVN

SEQ ID NO: 3331 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSQTKSELQFSQAGASDIRDQSRNWLPGPCYRQQRVSKKYTDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3332 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQRGNRQAATADVN

SEQ ID NO: 3333 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPGDNNNSDFSWTGATKYHLNGRDSLVNPGPAMASHEDDAGKFFPQSGVLIFGKQSGGATDVEIENVMITDEEEIRTTNPVATEQYGSVSTNLQAGNAQAATADVN

SEQ ID NO: 3334 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDEGKFFPQSGVLIFGKQGSGKSNVAFGDVMITDEEEIRTTNPVATEQYGSVSTNLQAGNAQAATADVN

SEQ ID NO: 3335 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSTQASGNNNSEFSWTGATKYHLNGRDSLVNPGPAMASHRDDEDKFFPQSGVLIFGKEGATATNVEIDDVMITDEEEIRTTNPVATEQYGSVSTNLQAGNAQAATADVN

SEQ ID NO: 3336 - protein, 334 aa, Artificial Sequence; identical to SEQ ID NO: 315
  Synthetic

SEQ ID NO: 3337 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHEDDNEKFFPQSGVLIFGKEGSRRANVDIEYVMITDEEEIRTTNPVATEQYGSVSTNLQAGNAQAATADVN

SEQ ID NO: 3338 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKQDTSKANAAIGEVMITDEEEIRTTNPVATEQYGSVSTNLQAGNAQAATADVN

SEQ ID NO: 3339 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGNMTKSTLEFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3340 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRSDPAAYAAVQ

SEQ ID NO: 3341 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNVTQSGLMFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 3342 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATKYHLNGRDSLVNPGPAMASHRDDEDKFFPQSGVLIFGKEDSGGNDVEVEDVMITDEEEIRTTNPVATEQYGSVSTNLQAGNAQAATADVN

SEQ ID NO: 3343 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3344 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKQGGGKTNIDIGHVMITDEEEIRTTNPVATEQYGSVSTNLQAGNAQAATADVN

SEQ ID NO: 3345 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDEEKFFPQSGVLIFGKQSGKTADAEVGDVMITDEEEIRTTNPVATEQYGSVSTNLQAGNAQAATADVN

SEQ ID NO: 3346 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKTSADNNNSEYSWTGATKYHLNGRDSLVNPGPAMASHKDDEEKFFPQSGVLIFGKQNTGTANVEIEKVMITDEEEIRTTNPVATEQYGSVSTNLQAGNAQAATADVN

SEQ ID NO: 3347 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPGGLKTTSNLVFSQAGASDIRDQSRNWLPGPCYRQQRVSKTSADNNNSNFSWTGATKYHLNGRDSLVNPGPAMASHRDDEDKFFPQSGVLIFGKENAKGTNAEFEDVMITDEEEIRTTNPVATEQYGSVSTNLQAGNAQAATADVN

SEQ ID NO: 3348 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATEDVN

SEQ ID NO: 3349 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGTGPMTKSDLRFSQAGASDIRDQSRNWLPGPCYRQQRVSKQPSQNNNSNFSWTGATKYHLNGRDSLVNPGPAMASHEDDTDKFFPQSGVLIFGKENTSEGNVDIERVMITDEEEIRTTNPVATEQYGSVSTNLQAGNAQAATADVN

SEQ ID NO: 3350 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNGGRETLSRLKFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3351 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGAGGHVTMSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3352 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNKTMSALRFSQAGASDIRDQSRNWLPGPCYRQQRVSKTADHNNNSDFSWTGATKYHLNGRDSLVNPGPAMASHKDDEEKFFPQSGVLIFGKEGAGANDVAVEHVMITDEEEIRTTNPVATEQYGSVSTNLQAGNAQAATADVN

SEQ ID NO: 3353 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQGGNQTQSALRFSQAGASDIRDQSRNWLPGPCYRQQRVSKQSSDNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3354 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGIQTMSNLRFSQAGASDIRDQSRNWLPGPCYRQQRVSKTDGGNNNSEFSWPGATTYHLNGRDSLVNPGPAMASHRDDDERFFPQSGVLIFGKQGSEKTNVDIEKVMITDEEEIRTTNPVATEQYGSVSTNLQAGNAQAATADVN

SEQ ID NO: 3355 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQGTGTSNVDYGSVMITDEEEIRTTNPVATEQYGSVSTNLQAGNAQAATADVN

SEQ ID NO: 3356 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNKTLSRLKFSQAGASDIRDQSRNWLPGPCYRQQRVSKQPTGNNNSNFSWTGATKYHLNGRDSLVNPGPAMASHKDDDERFFPQSGVLIFGKEGANGGNADIEDVMITDEEEIRTTNPVATEQYGSVSTNLQAGNAQAATADVN

SEQ ID NO: 3357 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNGTGTVTPSELGFSQAGASDIRDQSRNWLPGPCYRQQRVSTTSGDNNNSNFSWTGATTYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 3358 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3359 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVH

SEQ ID NO: 3360 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVGIEKVMITDEEEIRTTNPVATEQYGSVSTNLQSPRDAAANAGVD

SEQ ID NO: 3361 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3362 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKQDSGRANVEIGEVMITDEEEIRTTNPVATEQYGSVSTNLQAGNAQAATADVN

SEQ ID NO: 3363 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPGGRQTTSELRFSQAGASDIRDQSRNWLPGPCYRQQRVSKQSDRNNNSDFSWTGATKYHLNGRDSLVNPGPAMASHRDDAEKFFPQSGVLIFGKQNSSRANAEIEEVMITDEEEIRTTNPVATEQYGSVSTNLQAGNAQAATADVN

SEQ ID NO: 3364 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKQSASKNNIAIEEVMITDEEEIRTTNPVATEQYGSVSTNLQAGNAQAATADVN

SEQ ID NO: 3365 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHEDDTGRFFPQSGVLIFGKESGTAANAAIEEVMITDEEEIRTTNPVATEQYGSVSTNLQAGNAQAATADVN

SEQ ID NO: 3366 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 3367 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSTQSTQNNNSEFSWTGATKYHLNGRDSLVNPGPAMASHKDDDDRFFPQSGVLIFGKEGADRNNVDIGSVMITDEEEIRTTNPVATEQYGSVSTNLQAGNAQAATADVN

SEQ ID NO: 3368 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKEGSDKNNVDYESVMITDEEEIRTTNPVATEQYGSVSTNLQAGNAQAATADVN

SEQ ID NO: 3369 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSTTPGGNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 3370 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLKKSTLQFSQAGASDIRDQSRNWLPGPCYRQQRVSKQPNDNNNSEFSWTGATTYHLNGRDSLVNPGPAMASHKDDNEKFFPQSGVLIFGKEGAGAANVEIDRVMITDEEEIRTTNPVATEQYGSVSTNLQAGNAQAATADVN

SEQ ID NO: 3371 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGANRDNADIDQVMITDEEEIRTTNPVATEQYGSVSTNLQAGNAQAATADVN

SEQ ID NO: 3372 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQDAAGANIEIGNVMITDEEEIRTTNPVATEQYGSVSTNLQAGNAQAATADVN

SEQ ID NO: 3373 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSDFSWTGATKYHLNGRDSLVNPGPAMASHKDDNDRFFPQSGVLIFGKQGTTGANVAYEDVMITDEEEIRTTNPVATEQYGSVSTNLQAGNAQAATADVN

SEQ ID NO: 3374 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADDNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3375 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKEGAAGNDVEFDQVMITDEEEIRTTNPVATEQYGSVSTNLQAGNAQAATADVN

SEQ ID NO: 3376 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPTGHPTMSRLRFSQAGASDIRDQSRNWLPGPCYRQQRVSKQPTRNNNSDFSWTGATKYHLNGRDSLVNPGPAMASHKDDDEKFFPQSGVLIFGKESGTGNDVEIDGVMITDEEEIRTTNPVATEQYGSVSTNLQAGNAQAATADVN

SEQ ID NO: 3377 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDDRFFPQSGVLIFGKQNASGTNADVGQVMITDEEEIRTTNPVATEQYGSVSTNLQAGNAQAATADVN

SEQ ID NO: 3378 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGNQTISSLGFSQAGASDIRDQSRNWLPGPCYRQQRVSTQSTGNNNSDFSWTGATKYHLNGRDSLVNPGPAMASHKDDDDRFFPQSGVLIFGKESAGKDDVAIDQVMITDEEEIRTTNPVATEQYGSVSTNLQAGNAQAATADVN

SEQ ID NO: 3379 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGSETNSPLHFSQAGASDIRDQSRNWLPGPCYRQQRVSKVSADNNNSEFSWTGATKYHLNGRDSLVNPGPAMASHKDDEEKFFPQSGVLIFGKEDAGKTNIDIGQVMITDEEEIRTTNPVATEQYGSVSTNLQAGNTQAATADVN

SEQ ID NO: 3380 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAAGNDVEFDQVMITDEEEIRTTNPVATEQYGSVSTNLQRGNRQAATADVN

SEQ ID NO: 3381 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSDFSWTGATKYHLNGRDSLVNPGPAMASHKDDEGRFFPQSGVLIFGKESGTANDVDIDRVMITDEEEIRTTNPVATEQYGSVSTNLQAGNAQAATADVN

SEQ ID NO: 3382 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTATGSNTISQLRFSQAGASDIRDQSRNWLPGPCYRQQRVSTKATDNNNSNFSWTGATTYHLNGRDSLVNPGPAMASHKDDEEKFFPQSGVLIFGKEGATATDAAIDQVMITDEEEIRTTNPVATEQYGSVSTNLQAGNAQAATADVN

SEQ ID NO: 3383 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSDFSWTGATKYHLNGRDSLVNPGPAMASHKDDADKFFPQSGVLIFGKQSAAKSNTEVDSVMITDEEEIRTTNPVATEQYGSVSTNLQAGNAQAATADVN

SEQ ID NO: 3384 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKQPNQNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3385 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDTRSGAASNAVP

SEQ ID NO: 3386 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPRTRAAATEVA

SEQ ID NO: 3387 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNATGIMTTSHLRFSQAGASDIRDQSRNWLPGPCYRQQRVSTTPADNNNSDFSWTGATKYHLNGRDSLVNPGPAMASHKDDDERFFPQSGVLIFGKQGSEKTNVDIEKVMITDEEEIRTTNPVATEQYGSVSTNLQRGNRQAATADVN

SEQ ID NO: 3388 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDTDNNNSEFSWTGATTYHLNGRDSLVNPGPAMASHRDDKDKFFPQSGVLIFGKQGSEKTNVDIEKVMITDEEEIRTTNPVATEQYGSVSTNLQAGNAQAATADVN

SEQ ID NO: 3389 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNQTNSDLKFSQAGASDIRDQSRNWLPGPCYRQQRVSKQHNQNNNSEFSWTGATTYHLNGRDSLVNPGPAMASHEDDKDKFFPQSGVLIFGKQGTGKANVDVGNVMITDEEEIRTTNPVATEQYGSVSTNLQAGNAQAATADVN

SEQ ID NO: 3390 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGGGGANAEVGDVMITDEEEIRTTNPVATEQYGSVSTNLQAGNAQAATADVN

SEQ ID NO: 3391 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRDNAATRVVE

SEQ ID NO: 3392 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSTTAAQNNNSDFSWTGATKYHLNGRDSLVNPGPAMASHGDDAERFFPQSGVLIFGKQGSEKTNVDIEKVMITDEEEIRTTNPVATEQYGSVSTNLQAGNAQAATADVN

SEQ ID NO: 3393 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQDGKGNDVDIDGVMITDEEEIRTTNPVATEQYGSVSTNLQRGNRQAATADVN

SEQ ID NO: 3394 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGAKGTNVAVEKVMITDEEEIRTTNPVATEQYGSVSTNLQAGNAQAATADVN

SEQ ID NO: 3395 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATAGTVTHSRLRFSQAGASDIRDQSRNWLPGPCYRQQRVSKQASDNNNSEFSWTGATKYHLNGRDSLVNPGPAMASHKDDEEKFFPQSGVLIFGKQSGDETDVEIDRVMITDEEEIRTTNPVATEQYGSVSTNLQAGNAQAATADVN

SEQ ID NO: 3396 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENASGTNVDIGNVMITDEEEIRTTNPVATEQYGSVSTNLQAGNAQAATADVN

SEQ ID NO: 3397 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKQGSEKTNVDIEKVMITDEEEIRTTNPVATEQYGSVSTNLQAGNAQAATADVN

SEQ ID NO: 3398 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGILTQSTLRFSQAGASDIRDQSRNWLPGPCYRQQRVSKQASDNNNSNFSWTGATTYHLNGRDSLVNPGPAMASHKDDEGRFFPQSGVLIFGKQGSEKTNVDIEKVMITDEEEIRTTNPVATEQYGSVSTNLQRGNRQAATADVN

SEQ ID NO: 3399 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHRDDEDKFFPQSGVLIFGKQGSEKTNVDIGKVMITDEEEIRTTNPVATEQYGSVSTNLQRGNRQAATADVN

SEQ ID NO: 3400 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDTDKFFPQSGVLIFGKQGSEKTNVDIEKVMITDEEEIRTTNPVATEQYGSVSTNLQAGNAQAATADVN

SEQ ID NO: 3401 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3402 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKQGSEKTNVDIEKVMITDEEEIRTTNPVATEQYGSVSTNLQRGNRQAATADVN

SEQ ID NO: 3403 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKESGDKANAAIGEVMITDEEEIRTTNPVATEQYGSVSTNLQAGNAQAATADVN

SEQ ID NO: 3404 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 3405 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTKTGNVTKSTLHFSQAGASDIRDQSRNWLPGPCYRQQRVSKQSADNNNSDFSWTGATKYHLNGRDSLVNPGPAMASHGDDTGKFFPQSGVLIFGKQGSEKTNVDIEKVMITDEEEIRTTNPVATEQYGSVSTNLQAGNAQAATADVN

SEQ ID NO: 3406 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTAGDNNNSEFSWTGATTYHLNGRDSLVNPGPAMASHKDDDDKFFPQSGVLIFGKQGTKRDDVAIDEVMITDEEEIRTTNPVATEQYGSVSTNLQAGNAQAATADVN

SEQ ID NO: 3407 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGHPTKSRLVFSQAGASDIRDQSRNWLPGPCYRQQRVSKVSADNNNSEFSWTGATKYHLNGRDSLVNPGPAMASHRDDEGKFFPQSGVLIFGKEGSAASNVDIGGVMITDEEEIRTTNPVATEQYGSVSTNLQAGNAQAATADVN

SEQ ID NO: 3408 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNKTMSALRFSQAGASDIRDQSRNWLPGPCYRQQRVSKTYNDNNNSEFSWTGATTYHLNGRDSLVNPGPAMASHRDDNEKFFPQSGVLIFGKENGGAADVAIENVMITDEEEIRTTNPVATEQYGSVSTNLQAGNAQAATADVN

SEQ ID NO: 3409 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHRDDDGKFFPQSGVLIFGKEGSGASDVAIEQVMITDEEEIRTTNPVATEQYGSVSTNLQRGNRQAATADVN

SEQ ID NO: 3410 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTTGILTMSRLKFSQAGASDIRDQSRNWLPGPCYRQQRVSKTDGENNNSDFSWTGATKYHLNGRDSLVNPGPAMASHEDDNGRFFPQSGVLIFGKQGSEKTNVDIEKVMITDEEEIRTTNPVATEQYGSVSTNLQAGNAQAATADVN

SEQ ID NO: 3411 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKDRAAAAVHNVH

SEQ ID NO: 3412 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNDTTSNLGFSQAGASDIRDQSRNWLPGPCYRQQRVSTTAGDNNNSNFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 3413 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTHGDNNNSNFSWTGATTYHLNGRDSLVNPGPAMASHRDDADRFFPQSGVLIFGKQGSEKTNVDIEKVMITDEEEIRTTNPVATEQYGSVSTNLQAGNAQAATADVN

SEQ ID NO: 3414 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQGGSNTKSGLKFSQAGASDIRDQSRNWLPGPCYRQQRVSKTSADNNNSEYSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 3415 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 3416 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAHGGPPTLSNLKFSQAGASDIRDQSRNWLPGPCYRQQRVSKKSTGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3417 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQDGRAGNVEIGEVMITDEEEIRTTNPVATEQYGSVSTNLQAGNAQAATADVN

SEQ ID NO: 3418 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3419 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 3420 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDDDRFFPQSGVLIFGKEDSRKSNADIEGVMITDEEEIRTTNPVATEQYGSVSTNLQAGNAQAATADVN

SEQ ID NO: 3421 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSTQSTGNNNSDFSWTGATKYHLNGRDSLVNPGPAMASHKDDDDRFFPQSGVLIFGKEGAAGSDIDIEHVMITDEEEIRTTNPVATEQYGSVSTNLQAGNAQAATADVN

SEQ ID NO: 3422 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 3423 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGIETKSRLLFSQAGASDIRDQSRNWLPGPCYRQQRVSKKYTDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3424 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGTVTHSHLVFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3425 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATKYHLNGRDSLVNPGPAMASHEDDKDKFFPQSGVLIFGKQGSEKTNVDIEKVMITDEEEIRTTNPVATEQYGSVSTNLQAGNAQAATADVN

SEQ ID NO: 3426 - protein, 334 aa, Artificial Sequence; identical to SEQ ID NO: 503
  Synthetic

SEQ ID NO: 3427 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3428 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSRGNDVDVEEVMITDEEEIRTTNPVATEQYGSVSTNLQAGNAQAATADVN

SEQ ID NO: 3429 - protein, 334 aa, Artificial Sequence; identical to SEQ ID NO: 406
  Synthetic

SEQ ID NO: 3430 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEGSNIAIENVMITDEEEIRTTNPVATEQYGSVSTNLQAGNAQAATADVN

SEQ ID NO: 3431 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTDRFFPQSGVLIFGKEGAGGNNVEIESVMITDEEEIRTTNPVATEQYGSVSTNLQAGNAQAATADVN

SEQ ID NO: 3432 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDERFFPQSGVLIFGKEDANGGDAEIGHVMITDEEEIRTTNPVATEQYGSVSTNLQAGNAQAATADVN

SEQ ID NO: 3433 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDRFFPQSGVLIFGKQGSGKSNVAFGDVMITDEEEIRTTNPVATEQYGSVSTNLQAGNAQAATADVN

SEQ ID NO: 3434 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKEGSKASNVAVDHVMITDEEEIRTTNPVATEQYGSVSTNLQAGNAQAATADVN

SEQ ID NO: 3435 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDRGGSTTTSALRFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQRGNRQAATADVN

SEQ ID NO: 3436 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGGNADNAAVEDVMITDEEEIRTTNPVATEQYGSVSTNLQAGNAQAATADVN

SEQ ID NO: 3437 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSARNTAAYNNVT

SEQ ID NO: 3438 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATEYHLNGRDSLVNPGPAMASHKDDEEKFFPQSGVLIFGKQGSEKTNVDIEKVMITDEEEIRTTNPVATEQYGSVSTNLQDGKGQAAVDRVE

SEQ ID NO: 3439 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGTVTLSNLRFSQAGASDIRDQSRNWLPGPCYRQQRVSTTPADNNNSDFSWTGATKYHLNGRDSLVNPGPAMASHKDDDEKFFPQSGVLIFGKEGAKTADADIGHVMITDEEEIRTTNPVATEQYGSVSTNLQAGNAQAATADVN

SEQ ID NO: 3440 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGRNPAANEVVH

SEQ ID NO: 3441 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 3442 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATTYHLNGRDSLVNPGPAMASHRDDDEKFFPQSGVLIFGKQDTGKNNVAIERVMITDEEEIRTTNPVATEQYGSVSTNLQEKKTHAAADSVA

SEQ ID NO: 3443 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKEGATKSNAAFEEVMITDEEEIRTTNPVATEQYGSVSTNLQAGNAQAATADVN

SEQ ID NO: 3444 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAGKTDVDYGEVMITDEEEIRTTNPVATEQYGSVSTNLQRGNRQAATADVN

SEQ ID NO: 3445 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNNSGSATNSRLRFSQAGASDIRDQSRNWLPGPCYRQQRVSKTSADNNNSEYSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 3446 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTTSTLQFSQAGASDIRDQSRNWLPGPCYRQQRVSKTAGRNNNSDFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 3447 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQSTSRGDVDIGGVMITDEEEIRTTNPVATEQYGSVSTNLQAGNAQAATADVN

SEQ ID NO: 3448 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQNGGGANIDFDGVMITDEEEIRTTNPVATEQYGSVSTNLQAGNAQAATADVN

SEQ ID NO: 3449 - protein, 334 aa, Artificial Sequence; identical to SEQ ID NO: 343
  Synthetic

SEQ ID NO: 3450 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASTGINTLSTLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3451 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANSGTNTLSHLRFSQAGASDIRDQSRNWLPGPCYRQQRVSKVSADNNNSEFSWTGATKYHLNGRDSLVNPGPAMASHKDDEEKFFPQSGVLIFGKQSGGRSNVEIDQVMITDEEEIRTTNPVATEQYGSVSTNLQAGNAQAATADVN

SEQ ID NO: 3452 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGRVTPSRLGFSQAGASDIRDQSRNWLPGPCYRQQRVSTTAGDNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3453 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQDASKNNVDVDGVMITDEEEIRTTNPVATEQYGSVSTNLQAGNAQAATADVN

SEQ ID NO: 3454 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGGGGANAEVGDVMITDEEEIRTTNPVATEQYGSVSTNLQAGNAQAATADVN

SEQ ID NO: 3455 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGAAKNNVAFGEVMITDEEEIRTTNPVATEQYGSVSTNLQAGNAQAATADVN

SEQ ID NO: 3456 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKTGNETPSRLMFSQAGASDIRDQSRNWLPGPCYRQQRVSKQHNQNNNSNFSWTGATTYHLNGRDSLVNPGPAMASHKDDEGRFFPQSGVLIFGKQNAGATDVAFDEVMITDEEEIRTTNPVATEQYGSVSTNLQAGNAQAATADVN

SEQ ID NO: 3457 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSKTHDGNNNSEFSWTGATKYHLNGRDSLVNPGPAMASHRDDEDKFFPQSGVLIFGKEGGAGADVDIGQVMITDEEEIRTTNPVATEQYGSVSTNLQAGNAQAATADVN

SEQ ID NO: 3458 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKEGSTEGNVDVDSVMITDEEEIRTTNPVATEQYGSVSTNLQAGNAQAATADVN

SEQ ID NO: 3459 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSTTASHNNNSDFSWTGATKYHLNGRDSLVNPGPAMASHKDDDEKFFPQSGVLIFGKQGARRSNADFDDVMITDEEEIRTTNPVATEQYGSVSTNLQAGNAQAATADVN

SEQ ID NO: 3460 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQRNGAATSIVT

SEQ ID NO: 3461 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSATGPVTTSQLGFSQAGASDIRDQSRNWLPGPCYRQQRVSKTSTENNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3462 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 3463 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSSAGTVTHSHLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3464 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENGRGGNAEVEDVMITDEEEIRTTNPVATEQYGSVSTNLQAGNAQAATADVN

SEQ ID NO: 3465 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPGGRQTTSELRFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 3466 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSKQSSDNNNSEFSWTGATKYHLNGRDSLVNPGPAMASHRDDEDKFFPQSGVLIFGKQSANESDVDIDQVMITDEEEIRTTNPVATEQYGSVSTNLQAGNAQAATADVN

SEQ ID NO: 3467 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 3468 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDAGRFFPQSGVLIFGKQNAERANTDIGKVMITDEEEIRTTNPVATEQYGSVSTNLQAGNAQAATADVN

SEQ ID NO: 3469 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEGSGKSNTDFDSVMITDEEEIRTTNPVATEQYGSVSTNLQAGNAQAATADVN

SEQ ID NO: 3470 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPKDRAAAQEVP

SEQ ID NO: 3471 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGNMTKSTLEFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3472 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHGGNKTISNLRFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 3473 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGRSGAAFAIVQ

SEQ ID NO: 3474 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPSHNNNSDFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3475 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNKTMSALRFSQAGASDIRDQSRNWLPGPCYRQQRVSKQPSRNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3476 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDRFFPQSGVLIFGKQNAEASNADIDRVMITDEEEIRTTNPVATEQYGSVSTNLQAGNAQAATADVN

SEQ ID NO: 3477 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSTGTDVAYEGVMITDEEEIRTTNPVATEQYGSVSTNLQAGNAQAATADVN

SEQ ID NO: 3478 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGSLTQSRLRFSQAGASDIRDQSRNWLPGPCYRQQRVSKQDGGNNNSEFSWTGATTYHLNGRDSLVNPGPAMASHRDDDDKFFPQSGVLIFGKENAGASDIAIDHVMITDEEEIRTTNPVATEQYGSVSTNLQAGNAQAATADVN

SEQ ID NO: 3479 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQDSDKTNAEFGDVMITDEEEIRTTNPVATEQYGSVSTNLQAGNAQAATADVN

SEQ ID NO: 3480 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3481 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 3482 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNDNNNSEFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3483 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDSTGNNIDIEQVMITDEEEIRTTNPVATEQYGSVSTNLQAGNAQAATADVN

SEQ ID NO: 3484 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNAGIATKSHLGFSQAGASDIRDQSRNWLPGPCYRQQRVSKTSADNNNSNFSWTGATKYHLNGRDSLVNPGPAMASHRDDEDKFFPQSGVLIFGKEGAAKNDADIDDVMITDEEEIRTTNPVATEQYGSVSTNLQAGNAQAATADVN

SEQ ID NO: 3485 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSATGNLTPSNLLFSQAGASDIRDQSRNWLPGPCYRQQRVSKTSADNNNSEYSWTGATKYHLNGRDSLVNPGPAMASHKDDEEKFFPQSGVLIFGKQNARGNDAEFEEVMITDEEEIRTTNPVATEQYGSVSTNLQAGNAQAATADVN

SEQ ID NO: 3486 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDQKATAASQMVA

SEQ ID NO: 3487 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGTSKDNVAFDQVMITDEEEIRTTNPVATEQYGSVSTNLQAGNAQAATADVN

SEQ ID NO: 3488 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTDRFFPQSGVLIFGKQGSEKTNVDIEKVMITDEEEIRTTNPVATEQYGSVSTNLQAGNAQAATADVN

SEQ ID NO: 3489 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRSGLETKSRLRFSQAGASDIRDQSRNWLPGPCYRQQRVSKTSAANNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3490 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTHTENNNSNFSWTGATTYHLNGRDSLVNPGPAMASHGDDKERFFPQSGVLIFGKQGSARADVAYEGVMITDEEEIRTTNPVATEQYGSVSTNLQAGNAQAATADVN

SEQ ID NO: 3491 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3492 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 3493 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEGAKGSDVAYEGVMITDEEEIRTTNPVATEQYGSVSTNLQAGNAQAATADVN

SEQ ID NO: 3494 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGSTTPSRLQFSQAGASDIRDQSRNWLPGPCYRQQRVSTKHDRNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3495 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 3496 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRAGTKTISKLHFSQAGASDIRDQSRNWLPGPCYRQQRVSKQASDNNNSEFSWTGATKYHLNGRDSLVNPGPAMASHRDDEEKFFPQSGVLIFGKQSGGESDAAIEEVMITDEEEIRTTNPVATEQYGSVSTNLQAGNAQAATADVN

SEQ ID NO: 3497 - protein, 334 aa, Artificial Sequence
  Synthetic
DTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3498 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARQGTAASSDVN

SEQ ID NO: 3499 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATKYHLNGRDSLVNPGPAMASHKDDDDRFFPQSGVLIFGKEGSGGDNADIEGVMITDEEEIRTTNPVATEQYGSVSTNLQAGNAQAATADVN

SEQ ID NO: 3500 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3501 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKEGSRRDNAAIEHVMITDEEEIRTTNPVATEQYGSVSTNLQAGNAQAATADVN

SEQ ID NO: 3502 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQSARGTDVAVDDVMITDEEEIRTTNPVATEQYGSVSTNLQAGNAQAATADVN

SEQ ID NO: 3503 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGNLTLSNLLFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3504 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKENSKANNVDIGGVMITDEEEIRTTNPVATEQYGSVSTNLQAGNAQAATADVN

SEQ ID NO: 3505 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQDAGKSNADIDRVMITDEEEIRTTNPVATEQYGSVSTNLQAGNAQAATADVN

SEQ ID NO: 3506 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAARAGAATSAVN

SEQ ID NO: 3507 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWPGATKYHLNGRDSLVNPGPAMASHGDDKEKFFPQSGVLIFGKQGSEKTNVDIEKVMITDEEEIRTTNPVATEQYGSVSTNLQAGNAQAATADVN

SEQ ID NO: 3508 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSQSGRATQSDLSFSQAGASDIRDQSRNWLPGPCYRQQRVSKTDGENNNSDFSWTGATKYHLNGRDSLVNPGPAMASHKDDEEKFFPQSGVLIFGKEGAKESNVDIGQVMITDEEEIRTTNPVATEQYGSVSTNLQAGNAQAATADVN

SEQ ID NO: 3509 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPNHNNNSNFSWTGATTYHLNGRDSLVNPGPAMASHKDDEEKFFPQSGVLIFGKQGSTANDVAIDGVMITDEEEIRTTNPVATEQYGSVSTNLQAGNAQAATADVN

SEQ ID NO: 3510 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSARSNADFDGVMITDEEEIRTTNPVATEQYGSVSTNLQAGNAQAATADVN

SEQ ID NO: 3511 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 3512 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDADKFFPQSGVLIFGKQNAGASDADFDQVMITDEEEIRTTNPVATEQYGSVSTNLQAGNAQAATADVN

SEQ ID NO: 3513 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGHNNNSNFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 3514 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGAGANNADIESVMITDEEEIRTTNPVATEQYGSVSTNLQAGNAQAATADVN

SEQ ID NO: 3515 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRKAPAAFEDVA

SEQ ID NO: 3516 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDTDNNNSEFSWTGATTYHLNGRDSLVNPGPAMASHRDDKDKFFPQSGVLIFGKQGSEKTNVDIEKVMITDEEEIRTTNPVATEQYGSVSTNLQAGNAQAATADVN

SEQ ID NO: 3517 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKATDNNNSNFSWTGATTYHLNGRDSLVNPGPAMASHKDDDEKFFPQSGVLIFGKQDAGANNAEVDHVMITDEEEIRTTNPVATEQYGSVSTNLQAGNAQAATADVN

SEQ ID NO: 3518 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGDNNNSEFSWPGATKYHLNGRDSLVNPGPAMASHKDDEEKFFPQSGVLIFGKESSGEGNVDVDSVMITDEEEIRTTNPVATEQYGSVSTNLQRGNRQAATADVN

SEQ ID NO: 3519 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNQGGTVTLSNLRFSQAGASDIRDQSRNWLPGPCYRQQRVSKVSADNNNSEFSWTGATKYHLNGRDSLVNPGPAMASHKDDEDRFFPQSGVLIFGKQGSEKTNVDIEKVMITDEEEIRTTNPVATEQYGSVSTNLQRGNRQAATADVN

SEQ ID NO: 3520 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTENNNSEFSWTGATTYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 3521 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQNARASDAAVDQVMITDEEEIRTTNPVATEQYGSVSTNLQAGNAQAATADVN

SEQ ID NO: 3522 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3523 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARAGIETQSRLLFSQAGASDIRDQSRNWLPGPCYRQQRVSKQSDRNNNSEFSWTGATKYHLNGRDSLVNPGPAMASHKDDEDEFFPQSGVLIFGKQNGGGNNVEIDGVMITDEEEIRTTNPVATEQYGSVSTNLQAGNAQAATADVN

SEQ ID NO: 3524 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDGSDPAASTKVE

SEQ ID NO: 3525 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQASGNNNSEFSWTGATKYHLNGRDSLVNPGPAMASHKDDEEKFFPQSGVLIFGKQSGGGDNVEIDDVMITDEEEIRTTNPVATEQYGSVSTNLQAGNAQAATADVN

SEQ ID NO: 3526 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGIQTTSKLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3527 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHEDDADKFFPQSGVLIFGKQGSEKTNVDIEKVMITDEEEIRTTNPVATEQYGSVSTNLQGAHDNAAFETVQ

SEQ ID NO: 3528 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 3529 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRARAADDVVQ

SEQ ID NO: 3530 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHGDDKDKFFPQSGVLIFGKENASGTNVDIGNVMITDEEEIRTTNPVATEQYGSVSTNLQAGNAQAATADVN

SEQ ID NO: 3531 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGHTRAADDVVA

SEQ ID NO: 3532 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRAPAAVRTVD

SEQ ID NO: 3533 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSMTMSTLKFSQAGASDIRDQSRNWLPGPCYRQQRVSTKDTDNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3534 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGGSGSNVAVDKVMITDEEEIRTTNPVATEQYGSVSTNLQAGNAQAATADVN

SEQ ID NO: 3535 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTDGENNNSDFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 3536 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 3537 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKESAAKDNVEIGNVMITDEEEIRTTNPVATEQYGSVSTNLQAGNAQAATADVN

SEQ ID NO: 3538 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3539 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNADAGTHTKSSLQFSQAGASDIRDQSRNWLPGPCYRQQRVSKQSSDNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3540 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPAGNTTLSRLLFSQAGASDIRDQSRNWLPGPCYRQQRVSKVSADNNNSEFSWTGATKYHLNGRDSLVNPGPAMASHRDDEDKFFPQSGVLIFGKEGAAGSDVDIEKVMITDEEEIRTTNPVATEQYGSVSTNLQSGSNGAATGGVT

SEQ ID NO: 3541 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGRETISRLQFSQAGASDIRDQSRNWLPGPCYRQQRVSKQDTDNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 3542 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGSHTMSNLKFSQAGASDIRDQSRNWLPGPCYRQQRVSKQSSDNNNSEFSWTGATKYHLNGRDSLVNPGPAMASHRDDNGKFFPQSGVLIFGKEDAGKTNIDIGQVMITDEEEIRTTNPVATEQYGSVSTNLQAGNAQAATADVN

SEQ ID NO: 3543 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPDNRNNTSDFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 3544 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKQGGGKTNIDIGHVMITDEEEIRTTNPVATEQYGSVSTNLQAGNAQAATADVN

SEQ ID NO: 3545 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAKHTAAASEGVT

SEQ ID NO: 3546 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDEERFFPQSGVLIFGKQGAEANNVAFEDVMITDEEEIRTTNPVATEQYGSVSTNLQAGNAQAATADVN

SEQ ID NO: 3547 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSTTPADNNNSDFSLTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3548 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAGGSKTHSQLSFSQAGASDIRDQSRNWLPGPCYRQQRVSKQSSDNNNSEFSWTGATKYHLNGRDSLVNPGPAMASHRDDAEKFFPQSGVLIFGKQGSEKTNVDIEKVMITDEEEIRTTNPVATEQYGSVSTNLQAGNAQAATADVN

SEQ ID NO: 3549 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRTGTQTHSQLLFSQAGASDIRDQSRNWLPGPCYRQQRVSKQPTGNNNSNFSWTGATKYHLNGRDSLVNPGPAMASHKDDEEKFFPQSGVLIFGKQNAAKANVDIGDVMITDEEEIRTTNPVATEQYGSVSTNLQAGNAQAATADVN

SEQ ID NO: 3550 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3551 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDATKTNVAIDGVMITDEEEIRTTNPVATEQYGSVSTNLQAGNAQAATADVN

SEQ ID NO: 3552 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRTGLLTTSGLRFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 3553 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRSGPNTMSKLIFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQHDQAAVANVE

SEQ ID NO: 3554 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRSGLETKSRLRFSQAGASDIRDQSRNWLPGPCYRQQRVSKTSAANNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3555 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSEFSWPGATTYHLNGRDSLVNPGPAMASHEDDAERFFPQSGVLIFGKQGSEKTNVDIEKVMITDEEEIRTTNPVATEQYGSVSTNLQAGNAQAATADVN

SEQ ID NO: 3556 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3557 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDAGKFFPQSGVLIFGKQGSEKTNVDIEKVMITDEEEIRTTNPVATEQYGSVSTNLQAGNAQAATADVN

SEQ ID NO: 3558 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAKGGNMTLSRLKFSQAGASDIRDQSRNWLPGPCYRQQRVSKTDGENNNSDFSWTGATKYHLNGRDSLVNPGPAMASHKDDEEKFFPQSGVLIFGKESGGTDNVDIDHVMITDEEEIRTTNPVATEQYGSVSTNLQAGNAQAATADVN

SEQ ID NO: 3559 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHGDDNDKFFPQSGVLIFGKEGTATANIDVGSVMITDEEEIRTTNPVATEQYGSVSTNLQAGNAQAATADVN

SEQ ID NO: 3560 - protein, 334 aa, Artificial Sequence; identical to SEQ ID NO: 320
  Synthetic

SEQ ID NO: 3561 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 3562 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGTRKNNVDIEQVMITDEEEIRTTNPVATEQYGSVSTNLQAGNAQAATADVN

SEQ ID NO: 3563 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKENAGAANVEFGQVMITDEEEIRTTNPVATEQYGSVSTNLQAGNAQAATADVN

SEQ ID NO: 3564 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLSFSQAGASDIRDQSRNWLPGPCYRQQRVSKQSSDNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3565 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGLNTISGLRFSQAGASDIRDQSRNWLPGPCYRQQRVSKTSADNNNSEYSWTGATKYHLNGRDSLVNPGPAMASHKDDDDRFFPQSGVLIFGKEGGSGSNVAVDKVMITDEEEIRTTNPVATEQYGSVSTNLQAGNAQAATADVN

SEQ ID NO: 3566 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGANTNNTAIDSVMITDEEEIRTTNPVATEQYGSVSTNLQAGNAQAATADVN

SEQ ID NO: 3567 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3568 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKTPNGNNNSDFSWTGATKYHLNGRDSLVNPGPAMASHGDDNDRFFPQSGVLIFGKQGSEKTNVDIEKVMITDEEEIRTTNPVATEQYGSVSTNLQAGNAQAATADVN

SEQ ID NO: 3569 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAAGNITLSKLNFSQAGASDIRDQSRNWLPGPCYRQQRVSKTPNGNNNSDFSWTGATKYHLNGRDSLVNPGPAMASHGDDNDRFFPQSGVLIFGKQGSEKTNVDIEKVMITDEEEIRTTNPVATEQYGSVSTNLQAGNAQAATADVN

SEQ ID NO: 3570 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDKEKFFPQSGVLIFGKQNAKGANVDIEHVMITDEEEIRTTNPVATEQYGSVSTNLQAGNAQAATADVN

SEQ ID NO: 3571 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEDASGTNVDFDRVMITDEEEIRTTNPVATEQYGSVSTNLQAGNAQAATADVN

SEQ ID NO: 3572 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQSASKNNIDIGDVMITDEEEIRTTNPVATEQYGSVSTNLQAGNAQAATADVN

SEQ ID NO: 3573 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKEGTGRANVAIERVMITDEEEIRTTNPVATEQYGSVSTNLQAGNAQAATADVN

SEQ ID NO: 3574 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSTGTNTDIGQVMITDEEEIRTTNPVATEQYGSVSTNLQAGNAQAATADVN

SEQ ID NO: 3575 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 3576 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKQDADAANVAVDKVMITDEEEIRTTNPVATEQYGSVSTNLQAGNAQAATADVN

SEQ ID NO: 3577 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTSADNNNSEYSWTGATKYHLNGRDSLVNPGPAMASHRDDNDKFFPQSGVLIFGKQGAGKNNAAIGQVMITDEEEIRTTNPVATEQYGSVSTNLQRGNRQAATADVN

SEQ ID NO: 3578 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADRFFPQSGVLIFGKENSDKTNADIGDVMITDEEEIRTTNPVATEQYGSVSTNLQAGNAQAATADVN

SEQ ID NO: 3579 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGIVTTSELRFSQAGASDIRDQSRNWLPGPCYRQQRVSKTHGDNNNSNFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 3580 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKSGLATKSNLGFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 3581 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKEGAGRDDVDIDRVMITDEEEIRTTNPVATEQYGSVSTNLQAGNAQAATADVN

SEQ ID NO: 3582 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGKSNPAASQAVP

SEQ ID NO: 3583 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKQGSEKTNVDIEKVMITDEEEIRTTNPVATEQYGSVSTNLQRGNRQAATADVN

SEQ ID NO: 3584 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQGTAADNVDVGGVMITDEEEIRTTNPVATEQYGSVSTNLQAGNAQAATADVN

SEQ ID NO: 3585 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGPTTLSRLGFSQAGASDIRDQSRNWLPGPCYRQQRVSKVSADNNNSEFSWTGATKYHLNGRDSLVNPGPAMASHKDDEEKFFPQSGVLIFGKENSGETNIAIDRVMITDEEEIRTTNPVATEQYGSVSTNLQRGNRQAATADVN

SEQ ID NO: 3586 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQGSEKTNVDIEKVMITDEEEIRTTNPVATEQYGSVSTNLQRGNRQAATADVN

SEQ ID NO: 3587 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQARHNAAADSMVA

SEQ ID NO: 3588 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDKGGHMTLSGLRFSQAGASDIRDQSRNWLPGPCYRQQRVSKQSADNNNSDFSWTGATKYHLNGRDSLVNPGPAMASHKDDADKFFPQSGVLIFGKQSADGSDVDIDRVMITDEEEIRTTNPVATEQYGSVSTNLQAGNAQAATADVN

SEQ ID NO: 3589 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSGGNMTHSALRFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3590 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGASKNNIAIGDVMITDEEEIRTTNPVATEQYGSVSTNLQAGNAQAATADVN

SEQ ID NO: 3591 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSNFSWTGATKYHLNGRDSLVNPGPAMASHKDDNDRFFPQSGVLIFGKEGGAKNNVAIEHVMITDEEEIRTTNPVATEQYGSVSTNLQAGNAQAATADVN

SEQ ID NO: 3592 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGTTTNSELRFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3593 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 3594 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKEGSNTANADIGEVMITDEEEIRTTNPVATEQYGSVSTNLQAGNAQAATADVN

SEQ ID NO: 3595 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNAPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGGGGNNIEIERVMITDEEEIRTTNPVATEQYGSVSTNLQRGNRQAATADVN

SEQ ID NO: 3596 - protein, 334 aa, Artificial Sequence; identical to SEQ ID NO: 327
  Synthetic

SEQ ID NO: 3597 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEGKFFPQSGVLIFGKEGGNGSNVDIGRVMITDEEEIRTTNPVATEQYGSVSTNLQAGNAQAATADVN

SEQ ID NO: 3598 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGGGNLTQSRLNFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3599 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKEGTTKANVDVGDVMITDEEEIRTTNPVATEQYGSVSTNLQAGNAQAATADVN

SEQ ID NO: 3600 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSMTMSTLKFSQAGASDIRDQSRNWLPGPCYRQQRVSTKDTDNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3601 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTSADNNNSEYSWTGATKYHLNGRDSLVNPGPAMASHRDDNDKFFPQSGVLIFGKEDSGRTNVDFERVMITDEEEIRTTNPVATEQYGSVSTNLQAGNAQAATADVN

SEQ ID NO: 3602 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAETGTATTSRLKFSQAGASDIRDQSRNWLPGPCYRQQRVSKQPTGNNNSNFSWTGATKYHLNGRDSLVNPGPAMASHEDDAGRFFPQSGVLIFGKESAGRSNVDVDRVMITDEEEIRTTNPVATEQYGSVSTNLQAGNAQAATADVN

SEQ ID NO: 3603 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDDDRFFPQSGVLIFGKEGAGESNADYEQVMITDEEEIRTTNPVATEQYGSVSTNLQAGNAQAATADVN

SEQ ID NO: 3604 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRKGGAADREVN

SEQ ID NO: 3605 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSAGRVTLSALRFSQAGASDIRDQSRNWLPGPCYRQQRVSKQSDRNNNSEFSWTGATKYHLNGRDSLVNPGPAMASHKDDEGRFFPQSGVLIFGKEDSGKSDVDFDEVMITDEEEIRTTNPVATEQYGSVSTNLQAGNAQAATADVN

SEQ ID NO: 3606 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDEKFFPQSGVLIFGKQNGNTGDVDIENVMITDEEEIRTTNPVATEQYGSVSTNLQAGNAQAATADVN

SEQ ID NO: 3607 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGAKGTNVAVEKVMITDEEEIRTTNPVATEQYGSVSTNLQAGNAQAATADVN

SEQ ID NO: 3608 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSGDAGNVEVEGVMITDEEEIRTTNPVATEQYGSVSTNLQAGNAQAATADVN

SEQ ID NO: 3609 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKEGSEKTNVDIEKVMITDEEEIRTTNPVATEQYGSVSTNLQAGNAQAATADVN

SEQ ID NO: 3610 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQESRAEAAVAGVH

SEQ ID NO: 3611 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGHRNSAAFSIVT

SEQ ID NO: 3612 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKDSRNNNSDFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 3613 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGTGIVTKSGLKFSQAGASDIRDQSRNWLPGPCYRQQRVSKTDGENNNSDFSWTGATKYHLNGRDSLVNPGPAMASHKDDEEKFFPQSGVLIFGKQSAEGGNVDIDGVMITDEEEIRTTNPVATEQYGSVSTNLQAGNAQAATADVN

SEQ ID NO: 3614 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQATRNTAAVDVVH

SEQ ID NO: 3615 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTHSGNVTTSGLRFSQAGASDIRDQSRNWLPGPCYRQQRVSKQHNQNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3616 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGNNAAADHVVH

SEQ ID NO: 3617 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKQSASKNNIAIEEVMITDEEEIRTTNPVATEQYGSVSTNLQAGNAQAATADVN

SEQ ID NO: 3618 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSANTGNVDIGEVMITDEEEIRTTNPVATEQYGSVSTNLQAGNAQAATADVN

SEQ ID NO: 3619 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQYGQNNNSDFSWTGATTYHLNGRDSLVNPGPAMASHEDDNGRFFPQSGVLIFGKQGSEKTNVDIEKVMITDEEEIRTTNPVATEQYGSVSTNLQAGNAQAATADVN

SEQ ID NO: 3620 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGTLTPSGLGFSQAGASDIRDQSRNWLPGPCYRQQRVSKKSTGNNNSDFSWTGATKYHLNGRDSLVNPGPAMASHRDDEDRFFPQSGVLIFGKQNAAKTNADIDDVMITDEEEIRTTNPVATEQYGSVSTNLQAGNAQAATADVN

SEQ ID NO: 3621 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQHNGNNNSNFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 3622 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARQSGAANGVVT

SEQ ID NO: 3623 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSTKDDRNNNSEFSWTGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 3624 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKDRTHAAFDMVN

SEQ ID NO: 3625 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKQNASEGNVEIEGVMITDEEEIRTTNPVATEQYGSVSTNLQAGNAQAATADVN

SEQ ID NO: 3626 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRHNPAASRDVQ

SEQ ID NO: 3627 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRKTGAAAEVVA

SEQ ID NO: 3628 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDARAADADIEQVMITDEEEIRTTNPVATEQYGSVSTNLQAGNAQAATADVN

SEQ ID NO: 3629 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 3630 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 3631 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNATGTNVDVGSVMITDEEEIRTTNPVATEQYGSVSTNLQAGNAQAATADVN

SEQ ID NO: 3632 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAAKTPAAAGGVA

SEQ ID NO: 3633 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGSVTQSHLRFSQAGASDIRDQSRNWLPGPCYRQQRVSKPPNGNNNSEFSWTGATTYHLNGRDSLVNPGPAMASHKDDDDRFFPQSGVLIFGKQNAGATDVAFDEVMITDEEEIRTTNPVATEQYGSVSTNLQAGNAQAATADVN

SEQ ID NO: 3634 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDNDKFFPQSGVLIFGKQGSEKTNVDIEKVMITDEEEIRTTNPVATEQYGSVSTNLQAGNAQAATADVN

SEQ ID NO: 3635 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNENNAAAFDVVT

SEQ ID NO: 3636 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTTGILTMSRLKFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 3637 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAKGGPTTHSPLRFSQAGASDIRDQSRNWLPGPCYRQQRVSKKDDGNNNSNFSWTGATTYHLNGRDSLVNPGPAMASHRDDEDRFFPQSGVLIFGKEGSGANDIDIGSVMITDEEEIRTTNPVATEQYGSVSTNLQAGNAQAATADVN

SEQ ID NO: 3638 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAAANNIEVEEVMITDEEEIRTTNPVATEQYGSVSTNLQRGNRQAATADVN

SEQ ID NO: 3639 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNVTQSGLMFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 3640 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 3641 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGNTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTNTRAAFQMVE

SEQ ID NO: 3642 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 3643 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKESSSATNIDIDRVMITDEEEIRTTNPVATEQYGSVSTNLQRGNRQAATADVN

SEQ ID NO: 3644 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNQTQSPLKFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3645 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDEEKFFPQSGVLIFGKESGTGNDVEIDGVMITDEEEIRTTNPVATEQYGSVSTNLQAGNAQAATADVN

SEQ ID NO: 3646 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKPPNDNNNSEFSWTGATTYHLNGRDSLVNPGPAMASHRDDAEKFFPQSGVLIFGKQGSEKTNVDIEKVMITDEEEIRTTNPVATEQYGSVSTNLQAGNAQAATADVN

SEQ ID NO: 3647 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKESAEAGNVEIGEVMITDEEEIRTTNPVATEQYGSVSTNLQAGNAQAATADVN

SEQ ID NO: 3648 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSKLRFSQAGASDIRDQSRNWLPGPCYRQQRVSKTSTDNNNSNFSWTGATTYHLNGRDSLVNPGPAMASHKDDDEKFFPQSGVLIFGKEGGTKGNTDIGHVMITDEEEIRTTNPVATEQYGSVSTNLQAGNAQAATADVN

SEQ ID NO: 3649 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGTLTTSNLRFSQAGASDIRDQSRNWLPGPCYRQQRVSTTSNENNNSDFSWTGATKYHLNGRDSLVNPGPAMASHKDDDDRFFPQSGVLIFGKHGAKGSNAAYDSVMITDEEEIRTTNPVATEQYGSVSTNLQAGNAQAATADVN

SEQ ID NO: 3650 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKQSSDNNNSEFSWTGATKYHLNGRDSLVNPGPAMASHEDDNEKFFPQSGVLIFGKQGSGKSDIDFDEVMITDEEEIRTTNPVATEQYGSVSTNLQAGNAQAATADVN

SEQ ID NO: 3651 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAQRNPAATAMVQ

SEQ ID NO: 3652 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQNGGAADAEIEHVMITDEEEIRTTNPVATEQYGSVSTNLQAGNAQAATADVN

SEQ ID NO: 3653 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3654 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDDRFFPQSGVLIFGKEGSGKSDAAIGDVMITDEEEIRTTNPVATEQYGSVSTNLQAGNAQAATADVN

SEQ ID NO: 3655 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQASRAQAASGDVA

SEQ ID NO: 3656 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKASDNNNSNFSWTGATTYHLNGRDSLVNPGPAMASHGDDAERFFPQSGVLIFGKQGSEKTNVDIEKVMITDEEEIRTTNPVATEQYGSVSTNLQAGNAQAATADVN

SEQ ID NO: 3657 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNATGTNVDVGSVMITDEEEIRTTNPVATEQYGSVSTNLQAGNAQAATADVN

SEQ ID NO: 3658 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKQDTDNNNSEFSWTGATTYHLNGRDSLVNPGPAMASHKDDDEKFFPQSGVLIFGKENAGASDIAIDHVMITDEEEIRTTNPVATEQYGSVSTNLQAGNAQAATADVN

SEQ ID NO: 3659 - protein, 334 aa, Artificial Sequence; identical to SEQ ID NO: 360
  Synthetic

SEQ ID NO: 3660 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3661 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAAGRHTLSQLNFSQAGASDIRDQSRNWLPGPCYRQQRVSKQSDHNNNSNFSWTGATKYHLNGRDSLVNPGPAMASHKDDEDKFFPQSGVLIFGKEGSAASNVDIGGVMITDEEEIRTTNPVATEQYGSVSTNLQAGNAQAATADVN

SEQ ID NO: 3662 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGRFFPQSGVLIFGKQGSEKTNVDIEKVMITDEEEIRTTNPVATEQYGSVSTNLQAGNAQAATADVN

SEQ ID NO: 3663 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 3664 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKEDAAKTNAAVDQVMITDEEEIRTTNPVATEQYGSVSTNLQAGNAQAATADVN

SEQ ID NO: 3665 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAATGNTTPSPLRFSQAGASDIRDQSRNWLPGPCYRQQRVSTQADRNNNSNFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3666 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATKYHLNGRDSLVNPGPAMASHEDDKDKFFPQSGVLIFGKQGSEKTNVDIEKVMITDEEEIRTTNPVATEQYGSVSTNLQAGNAQAATADVN

SEQ ID NO: 3667 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGTGNTTPSALQFSQAGASDIRDQSRNWLPGPCYRQQRVSKKDSRNNNSDFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 3668 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAPQNPAATDIVP

SEQ ID NO: 3669 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKEGTAGNNIEIGEVMITDEEEIRTTNPVATEQYGSVSTNLQAGNAQAATADVN

SEQ ID NO: 3670 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTKGKAAYAEVE

SEQ ID NO: 3671 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGSHTTSALRFSQAGASDIRDQSRNWLPGPCYRQQRVSTTPADNNNSDFSWTGATKYHLNGRDSLVNPGPAMASHKDDDDRFFPQSGVLIFGKEDGAATDAAIDEVMITDEEEIRTTNPVATEQYGSVSTNLQAGNAQAATADVN

SEQ ID NO: 3672 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSKQSDHNNNSNFSWTGATKYHLNGRDSLVNPGPAMASHKDDDDKFFPQSGVLIFGKQGARGADAEIESVMITDEEEIRTTNPVATEQYGSVSTNLQAGNAQAATADVN

SEQ ID NO: 3673 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGRETISRLQFSQAGASDIRDQSRNWLPGPCYRQQRVSKKSTGNNNSDFSWTGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 3674 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTSADNNNSEFSWPGATKYHLNGRDSLVNPGPAMASHRDDEEKFFPQSGVLIFGKQGSEKTNVDIEKVMITDEEEIRTTNPVATEQYGSVSTNLQRGNRQAATADVN

SEQ ID NO: 3675 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAEKFFPQSGVLIFGKQGSEKTNVDIEKVMITDEEEIRTTNPVATEQYGSVSTNLQRGNRQAATADVN

SEQ ID NO: 3676 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTNNAAAFGVVD

SEQ ID NO: 3677 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSSGNHTISPLRFSQAGASDIRDQSRNWLPGPCYRQQRVSKKYTDNNNSNFSWTGATTYHLNGRDSLVNPGPAMASHKDDEERFFPQSGVLIFGKENTSEGNVDIERVMITDEEEIRTTNPVATEQYGSVSTNLQAGNAQAATADVN

SEQ ID NO: 3678 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNAPSGHTTQSRLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 3679 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGSETNSRLRFSQAGASDIRDQSRNWLPGPCYRQQRVSKVSADNNNSEFSWTGATKYHLNGRDSLVNPGPAMASHKDDEEKFFPQSGVLIFGKQGATRDNTDIGHVMITDEEEIRTTNPVATEQYGSVSTNLQAGNAQAATADVN

SEQ ID NO: 3680 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHRDDAGRFFPQSGVLIFGKQGSEKTNVDIEKVMITDEEEIRTTNPVATEQYGSVSTNLQAGNAQAATADVN

SEQ ID NO: 3681 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSADKRNVDIGGVMITDEEEIRTTNPVATEQYGSVSTNLQAGNAQAATADVN

SEQ ID NO: 3682 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNETGPTTKSKLGFSQAGASDIRDQSRNWLPGPCYRQQRVSTKYTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3683 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENSDASNVDVEEVMITDEEEIRTTNPVATEQYGSVSTNLQAGNAQAATADVN

SEQ ID NO: 3684 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQGGRLTLSTLRFSQAGASDIRDQSRNWLPGPCYRQQRVSKTSADNNNSNFSWTGATKYHLNGRDSLVNPGPAMASHRDDEDKFFPQSGVLIFGKQSASKNNIAIEEVMITDEEEIRTTNPVATEQYGSVSTNLQAGNAQAATADVN

SEQ ID NO: 3685 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKQGASETNVEIDKVMITDEEEIRTTNPVATEQYGSVSTNLQAGNAQAATADVN

SEQ ID NO: 3686 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDDRFFPQSGVLIFGKQGSEKTNVDIEKVMITDEEEIRTTNPVATEQYGSVSTNLQASSNHAAAKGVD

SEQ ID NO: 3687 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3688 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTPSALKFSQAGASDIRDQSRNWLPGPCYRQQRVSTTPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3689 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKASDNNNSNFSWTGATTYHLNGRDSLVNPGPAMASHEDDDDKFFPQSGVLIFGKQGTGASNVEVENVMITDEEEIRTTNPVATEQYGSVSTNLQAGNAQAATADVN

SEQ ID NO: 3690 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDEEKFFPQSGVLIFGKESTTEANVDIEKVMITDEEEIRTTNPVATEQYGSVSTNLQAGNAQAATADVN

SEQ ID NO: 3691 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDAENNNSDFSWTGATTYHLNGRDSLVNPGPAMASHKDDEEKFFPQSGVLIFGKEGAGKTDVAIGRVMITDEEEIRTTNPVATEQYGSVSTNLQAGNAQAATADVN

SEQ ID NO: 3692 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 3693 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHKDDTEKFFPQSGVLIFGKQGSEKTNVDIEKVMITDEEEIRTTNPVATEQYGSVSTNLQAGNAQAATADVN

SEQ ID NO: 3694 - protein, 334 aa, Artificial Sequence; identical to SEQ ID NO: 328
  Synthetic

SEQ ID NO: 3695 - protein, 334 aa, Artificial Sequence; identical to SEQ ID NO: 632
  Synthetic

SEQ ID NO: 3696 - protein, 334 aa, Artificial Sequence; identical to SEQ ID NO: 3047
  Synthetic

SEQ ID NO: 3697 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDTAAANVDVGEVMITDEEEIRTTNPVATEQYGSVSTNLQAGNAQAATADVN

SEQ ID NO: 3698 - protein, 334 aa, Artificial Sequence; identical to SEQ ID NO: 124
  Synthetic

SEQ ID NO: 3699 - protein, 334 aa, Artificial Sequence; identical to SEQ ID NO: 1380
  Synthetic

SEQ ID NO: 3700 - protein, 334 aa, Artificial Sequence; identical to SEQ ID NO: 2805
  Synthetic

SEQ ID NO: 3701 - protein, 334 aa, Artificial Sequence; identical to SEQ ID NO: 30
  Synthetic

SEQ ID NO: 3702 - protein, 334 aa, Artificial Sequence; identical to SEQ ID NO: 498
  Synthetic

SEQ ID NO: 3703 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGGGTGNAEFDQVMITDEEEIRTTNPVATEQYGSVSTNLQAGNAQAATADVN

SEQ ID NO: 3704 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQAGKAQAATADVN

SEQ ID NO: 3705 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKEGAGKTNIAVDRVMITDEEEIRTTNPVATEQYGSVSTNLQAGNAQAATADVN

SEQ ID NO: 3706 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDRFFPQSGVLIFGKESGTTANVDVGQVMITDEEEIRTTNPVATEQYGSVSTNLQAGNAQAATADVN

SEQ ID NO: 3707 - protein, 334 aa, Artificial Sequence; identical to SEQ ID NO: 105
  Synthetic

SEQ ID NO: 3708 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 3709 - protein, 334 aa, Artificial Sequence; identical to SEQ ID NO: 853
  Synthetic

SEQ ID NO: 3710 - protein, 334 aa, Artificial Sequence; identical to SEQ ID NO: 679
  Synthetic

SEQ ID NO: 3711 - protein, 334 aa, Artificial Sequence; identical to SEQ ID NO: 571
  Synthetic

SEQ ID NO: 3712 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKESSDGNNVAIDGVMITDEEEIRTTNPVATEQYGSVSTNLQAGNAQAATADVN

SEQ ID NO: 3713 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 3714 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKDKFFPQSGVLIFGKQGSEKTNVDIEKVMITDEEEIRTTNPVATEQYGSVSTNLQAGNAQAATADVN

SEQ ID NO: 3715 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGPATKSALGFSQAGASDIRDQSRNWLPGPCYRQQRVSKKPDQNNNSEFSWTGATKYHLNGRDSLVNPGPAMASHRDDDGRFFPQSGVLIFGKQGSEKTNVDIEKVMITDEEEIRTTNPVATEQYGSVSTNLQAGNAQAATADVN

SEQ ID NO: 3716 - protein, 334 aa, Artificial Sequence; identical to SEQ ID NO: 429
  Synthetic

SEQ ID NO: 3717 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDRFFPQSGVLIFGKESGRRTNVEIEQVMITDEEEIRTTNPVATEQYGSVSTNLQAGNAQAATADVN

SEQ ID NO: 3718 - protein, 334 aa, Artificial Sequence; identical to SEQ ID NO: 1552
  Synthetic

SEQ ID NO: 3719 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDAENNNSEFSWPGATTYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 3720 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSGYSWTGATKYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 3721 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 3722 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTPGFSQAGASDIRDQSRNWLPGPCYRQQRVSKQPGDNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 3723 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQCSEKTNVDIEKVMITDEEEIRTTNPVATEQYGSVSTNLQREKGGAATQNVN

SEQ ID NO: 3724 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDEESFFPQSGVLIFGKEGSEKTNVDIEKVMITDEEEIRTTNPVATEQYGSVSTNLQRGNRQAATADVN

SEQ ID NO: 3725 - protein, 334 aa, Artificial Sequence; identical to SEQ ID NO: 689
  Synthetic

SEQ ID NO: 3726 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGERTPAAARTVD

SEQ ID NO: 3727 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHDRNNNSNFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 3728 - protein, 334 aa, Artificial Sequence; identical to SEQ ID NO: 627
  Synthetic

SEQ ID NO: 3729 - protein, 334 aa, Artificial Sequence; identical to SEQ ID NO: 476
  Synthetic

SEQ ID NO: 3730 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDTAAANVDVGEVMITDEEEIRTTNPVATEQYGSVSTNLQAGNAQAATADVS

SEQ ID NO: 3731 - protein, 334 aa, Artificial Sequence; identical to SEQ ID NO: 354
  Synthetic

SEQ ID NO: 3732 - protein, 334 aa, Artificial Sequence; identical to SEQ ID NO: 350
  Synthetic

SEQ ID NO: 3733 - protein, 334 aa, Artificial Sequence; identical to SEQ ID NO: 314
  Synthetic

SEQ ID NO: 3734 - protein, 334 aa, Artificial Sequence; identical to SEQ ID NO: 30
  Synthetic

SEQ ID NO: 3735 - protein, 334 aa, Artificial Sequence; identical to SEQ ID NO: 44
  Synthetic

SEQ ID NO: 3736 - protein, 334 aa, Artificial Sequence; identical to SEQ ID NO: 94
  Synthetic

SEQ ID NO: 3737 - protein, 334 aa, Artificial Sequence; identical to SEQ ID NO: 29
  Synthetic

SEQ ID NO: 3738 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRDPAADTIVP

SEQ ID NO: 3739 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQGGIATQSRLKFSQAGASDIRDQSRNWLPGPCYRQQRVSKQSGQNNNSDFSWTGATKYHLNGRDSLVNPGPAMASHKDDEGKFFPQSGVLIFGKQNAGATDVDIGSVMITDEEEIRTTNPVATEQYGSVSTNLQAGNAQAATADVN

SEQ ID NO: 3740 - protein, 334 aa, Artificial Sequence; identical to SEQ ID NO: 619
  Synthetic

SEQ ID NO: 3741 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNQGGTVTLSNLRFSQAGASDIRDQSRNWLPGPCYRQQRVSKQPNDNNNSEFSWTGATTYHLNGRDSLVNPGPAMASHKDDNEKFFPQSGVLIFGKQNGGGNNVDVDQVMITDEEEIRTTNPVATEQYGSVSTNLQRGNRQAATADVN

SEQ ID NO: 3742 - protein, 334 aa, Artificial Sequence; identical to SEQ ID NO: 452
  Synthetic

SEQ ID NO: 3743 - protein, 334 aa, Artificial Sequence; identical to SEQ ID NO: 395
  Synthetic

SEQ ID NO: 3744 - protein, 334 aa, Artificial Sequence; identical to SEQ ID NO: 367
  Synthetic

SEQ ID NO: 3745 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGKATISGLKFSQAGASDIRDQSRNWLPGPCYRQQRVSKPHDDNNNSDFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 3746 - protein, 334 aa, Artificial Sequence; identical to SEQ ID NO: 561
  Synthetic

SEQ ID NO: 3747 - protein, 334 aa, Artificial Sequence; identical to SEQ ID NO: 115
  Synthetic

SEQ ID NO: 3748 - protein, 334 aa, Artificial Sequence; identical to SEQ ID NO: 393
  Synthetic

SEQ ID NO: 3749 - protein, 334 aa, Artificial Sequence; identical to SEQ ID NO: 232
  Synthetic

SEQ ID NO: 3750 - protein, 334 aa, Artificial Sequence; identical to SEQ ID NO: 237
  Synthetic

SEQ ID NO: 3751 - protein, 334 aa, Artificial Sequence; identical to SEQ ID NO: 329
  Synthetic

SEQ ID NO: 3752 - protein, 334 aa, Artificial Sequence; identical to SEQ ID NO: 105
  Synthetic

SEQ ID NO: 3753 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPTGIITPSDLRFSQAGASDIRDQSRNWLPGPCYRQQRVSKTSADNNNSEYSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 3754 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSNHNNNSNFSWTGATTYHLNGRDSLVNPGPAMASHKDDEGRFFPQSGVLIFGKQDAGANNAEVDHVMITDEEEIRTTNPVATEQYGSVSTNLQAGNAQAATADVN

SEQ ID NO: 3755 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHGDDTGKFFPQSGVLIFGKQGSEKTNVDIEKVMITDEEEIRTTNPVATEQYGSVSTNLQRGNRQAATADVN

SEQ ID NO: 3756 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTKAGSATTSALGFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3757 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDTGHTTISRLGFSQAGASDIRDQSRNWLPGPCYRQQRVSKQASDNNNSEFSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 3758 - protein, 334 aa, Artificial Sequence; identical to SEQ ID NO: 124
  Synthetic

SEQ ID NO: 3759 - protein, 334 aa, Artificial Sequence; identical to SEQ ID NO: 880
  Synthetic

SEQ ID NO: 3760 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKQGSEKTNVDIEKVMITDEEEIRTTNPVATEQYGSVSTNLQRRQDPAANEAVT

SEQ ID NO: 3761 - protein, 334 aa, Artificial Sequence; identical to SEQ ID NO: 415
  Synthetic

SEQ ID NO: 3762 - protein, 334 aa, Artificial Sequence; identical to SEQ ID NO: 39
  Synthetic

SEQ ID NO: 3763 - protein, 334 aa, Artificial Sequence; identical to SEQ ID NO: 2650
  Synthetic

SEQ ID NO: 3764 - protein, 334 aa, Artificial Sequence; identical to SEQ ID NO: 153
  Synthetic

SEQ ID NO: 3765 - protein, 334 aa, Artificial Sequence; identical to SEQ ID NO: 401
  Synthetic

SEQ ID NO: 3766 - protein, 334 aa, Artificial Sequence; identical to SEQ ID NO: 410
  Synthetic

SEQ ID NO: 3767 - protein, 334 aa, Artificial Sequence; identical to SEQ ID NO: 303
  Synthetic

SEQ ID NO: 3768 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKESSTGTNIDFDRVMITDEEEIRTTNPVATEQYGSVSTNLQAGNAQAATADVN

SEQ ID NO: 3769 - protein, 334 aa, Artificial Sequence; identical to SEQ ID NO: 792
  Synthetic

SEQ ID NO: 3770 - protein, 334 aa, Artificial Sequence; identical to SEQ ID NO: 96
  Synthetic

SEQ ID NO: 3771 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKESGTGANADFGKVMITDEEEIRTTNPVATEQYGSVSTNLQAGNAQAATADVN

SEQ ID NO: 3772 - protein, 334 aa, Artificial Sequence; identical to SEQ ID NO: 476
  Synthetic

SEQ ID NO: 3773 - protein, 334 aa, Artificial Sequence; identical to SEQ ID NO: 2492
  Synthetic

SEQ ID NO: 3774 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDGKTGDVDVGEVMITDEEEIRTTNPVATEQYGSVSTNLQAGNAQAATADVN

SEQ ID NO: 3775 - protein, 334 aa, Artificial Sequence; identical to SEQ ID NO: 567
  Synthetic

SEQ ID NO: 3776 - protein, 334 aa, Artificial Sequence; identical to SEQ ID NO: 2684
  Synthetic

SEQ ID NO: 3777 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTSTDNNNSDFSWPGATTYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 3778 - protein, 334 aa, Artificial Sequence; identical to SEQ ID NO: 919
  Synthetic

SEQ ID NO: 3779 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKEGGTRTNVAIESVMITDEEEIRTTNPVATEQYGSVSTNLQAGNAQAATADVN

SEQ ID NO: 3780 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKENATRSDTEIDQVMITDEEEIRTTNPVATEQYGSVSTNLQAGNAQAATADVN

SEQ ID NO: 3781 - protein, 334 aa, Artificial Sequence; identical to SEQ ID NO: 2955
  Synthetic

SEQ ID NO: 3782 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEGNAQAATADVN

SEQ ID NO: 3783 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADRFFPQSGVLIFGKQSSKATNTEIDSVMITDEEEIRTTNPVATEQYGSVSTNLQAGNAQAATADVN

SEQ ID NO: 3784 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDEGKFFPQSGVLIFGKENSNRTNIDIEGVMITDEEEIRTTNPVATEQYGSVSTNLQAGNAQAATADVN

SEQ ID NO: 3785 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNSGILTTSTLRFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3786 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 3787 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRAGRQTMSGLGFSQAGASDIRDQSRNWLPGPCYRQQRVSKQSDRNNNSEFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 3788 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKEGGGKTNVDFESVMITDEEEIRTTNPVATEQYGSVSTNLQAGNAQAATADVN

SEQ ID NO: 3789 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAARGGAAVSNVN

SEQ ID NO: 3790 - protein, 334 aa, Artificial Sequence; identical to SEQ ID NO: 2049
  Synthetic

SEQ ID NO: 3791 - protein, 334 aa, Artificial Sequence; identical to SEQ ID NO: 429
  Synthetic

SEQ ID NO: 3792 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKSGLATKSNLGFSQAGASDIRDQSRNWLPGPCYRQQRVSKTDGENNNSDFSWTGATKYHLNGRDSLVNPGPAMASHKDDEEKFFPQSGVLIFGKQGANKANVAVEDVMITDEEEIRTTNPVATEQYGSVSTNLQAGNAQAATADVN

SEQ ID NO: 3793 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRTTAADRVVE

SEQ ID NO: 3794 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRNDTAAFTEVD

SEQ ID NO: 3795 - protein, 334 aa, Artificial Sequence; identical to SEQ ID NO: 488
  Synthetic

SEQ ID NO: 3796 - protein, 334 aa, Artificial Sequence; identical to SEQ ID NO: 627
  Synthetic

SEQ ID NO: 3797 - protein, 334 aa, Artificial Sequence; identical to SEQ ID NO: 1784
  Synthetic

SEQ ID NO: 3798 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHEDDTDKFFPQSGVLIFGKQGSEKTNVDIEKVMITDEEEIRTTNPVATEQYGSVSTNLQAGNAQAATADVN

SEQ ID NO: 3799 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKGRFFPQSGVLIFGKQGAGKNNAAIGQVMITDEEEIRTTNPVATEQYGSVSTNLQAGNAQAATADVN

SEQ ID NO: 3800 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGSATNSRLRFSQAGASDIRDQSRNWLPGPCYRQQRVSKKDDGNNNSNFSWTGATTYHLNGRDSLVNPGPAMASHKDDDDRFFPQSGVLIFGKQSSGKSNIAIEGVMITDEEEIRTTNPVATEQYGSVSTNLQAGNAQAATADVN

SEQ ID NO: 3801 - protein, 334 aa, Artificial Sequence; identical to SEQ ID NO: 1256
  Synthetic

SEQ ID NO: 3802 - protein, 334 aa, Artificial Sequence; identical to SEQ ID NO: 1750
  Synthetic

SEQ ID NO: 3803 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHRDDADKFFPQSGVLIFGKQGARGADAEIESVMITDEEEIRTTNPVATEQYGSVSTNLQAGNAQAATADVN

SEQ ID NO: 3804 - protein, 334 aa, Artificial Sequence; identical to SEQ ID NO: 954
  Synthetic

SEQ ID NO: 3805 - protein, 334 aa, Artificial Sequence; identical to SEQ ID NO: 2749
  Synthetic

SEQ ID NO: 3806 - protein, 334 aa, Artificial Sequence; identical to SEQ ID NO: 613
  Synthetic

SEQ ID NO: 3807 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEGRFFPQSGVLIFGKQGSAASNADVGQVMITDEEEIRTTNPVATEQYGSVSTNLQAGNAQAATADVN

SEQ ID NO: 3808 - protein, 334 aa, Artificial Sequence; identical to SEQ ID NO: 2412
  Synthetic

SEQ ID NO: 3809 - protein, 334 aa, Artificial Sequence; identical to SEQ ID NO: 2471
  Synthetic

SEQ ID NO: 3810 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKQGARANNVAIDRVMITDEEEIRTTNPVATEQYGSVSTNLQAGNAQAATADVN

SEQ ID NO: 3811 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRSGNETMSRLSFSQAGASDIRDQSRNWLPGPCYRQQRVSKQPSENNNSDFSWTGATKYHLNGRDSLVNPGPAMASHKDDDGKFFPQSGVLIFGKQGATESDVDFDQVMITDEEEIRTTNPVATEQYGSVSTNLQAGNAQAATADVN

SEQ ID NO: 3812 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKGGRVTTSALGFSQAGASDIRDQSRNWLPGPCYRQQRVSKVSADNNNSEFSWTGATKYHLNGRDSLVNPGPAMASHRDDADRFFPQSGVLIFGKEGAGGTDIDIGNVMITDEEEIRTTNPVATEQYGSVSTNLQAGNAQAATADVN

SEQ ID NO: 3813 - protein, 334 aa, Artificial Sequence; identical to SEQ ID NO: 38
  Synthetic

SEQ ID NO: 3814 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEGKSPAAARAVN

SEQ ID NO: 3815 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTKDDRNNNSDFSWTGATKYHLNGRDSLVNPGPAMASHKDDDDRFFPQSGVLIFGKEGSAKADADIGDVMITDEEEIRTTNPVATEQYGSVSTNLQAGNAQAATADVN

SEQ ID NO: 3816 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGRAGAASTIVH

SEQ ID NO: 3817 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEKRGAAAVADVH

SEQ ID NO: 3818 - protein, 334 aa, Artificial Sequence
  Synthetic
RTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSTQPTENNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3819 - protein, 334 aa, Artificial Sequence; identical to SEQ ID NO: 853
  Synthetic

SEQ ID NO: 3820 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSNHNNNSNFSWTGATTYHLNGRDSLVNPGPAMASHKDDEGRFFPQSGVLIFGKQDAGANNAEVDHVMITDEEEIRTTNPVATEQYGSVSTNLQAGNAQAATADVN

SEQ ID NO: 3821 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNEKFFPQSGVLIFGKQGGAGADVDIGQVMITDEEEIRTTNPVATEQYGSVSTNLQAGNAQAATADVN

SEQ ID NO: 3822 - protein, 334 aa, Artificial Sequence; identical to SEQ ID NO: 927
  Synthetic

SEQ ID NO: 3823 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKENAGKGNIAIDQVMITDEEEIRTTNPVATEQYGSVSTNLQAGNAQAATADVN

SEQ ID NO: 3824 - protein, 334 aa, Artificial Sequence; identical to SEQ ID NO: 328
  Synthetic

SEQ ID NO: 3825 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGPATKSGLRFSQAGASDIRDQSRNWLPGPCYRQQRVSKTAADNNNSDFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 3826 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNVSWPGATTYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 3827 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKQGSEKTNVDIEKVMITDEEEIRTTNPVATEQYGSVSTNLQRRQDPAANEAVT

SEQ ID NO: 3828 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 3829 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGSDTLSRLKFSQAGASDIRDQSRNWLPGPCYRQQRVSKKDSRNNNSDFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 3830 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGSTGSNVEYDRVMITDEEEIRTTNPVATEQYGSVSTNLQAGNAQAATADVN

SEQ ID NO: 3831 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHRDDEDKFFPQSGVLIFGKQSSGGANIEIDDVMITDEEEIRTTNPVATEQYGSVSTNLQAGNAQAATADVN

SEQ ID NO: 3832 - protein, 334 aa, Artificial Sequence; identical to SEQ ID NO: 562
  Synthetic

SEQ ID NO: 3833 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNLTTSELRFSQAGASDIRDQSRNWLPGPCYRQQRVSKQDTDNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3834 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSTTPADNNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 3835 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGHTQAAFGGVT

SEQ ID NO: 3836 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 3837 - protein, 334 aa, Artificial Sequence; identical to SEQ ID NO: 833
  Synthetic

SEQ ID NO: 3838 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADRFFPQSGVLIFGKQSSKATNTEIDSVMITDEEEIRTTNPVATEQYGSVSTNLQAGNAQAATADVN

SEQ ID NO: 3839 - protein, 334 aa, Artificial Sequence; identical to SEQ ID NO: 566
  Synthetic

SEQ ID NO: 3840 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKESASTNNVDVDQVMITDEEEIRTTNPVATEQYGSVSTNLQAGNAQAATADVN

SEQ ID NO: 3841 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKENAAGGDTDIGRVMITDEEEIRTTNPVATEQYGSVSTNLQAGNAQAATADVN

SEQ ID NO: 3842 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGANRTNIAIGEVMITDEEEIRTTNPVATEQYGSVSTNLQAGNAQAATADVN

SEQ ID NO: 3843 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGPLTHSGLNFSQAGASDIRDQSRNWLPGPCYRQQRVSKTDDDNNNSDFSWTGATKYHLNGRDSLVNPGPAMASHKDDNDKFFPQSGVLIFGKQGSEKTNVDIEKVMITDEEEIRTTNPVATEQYGSVSTNLQRGNRQAATADVN

SEQ ID NO: 3844 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGDNNNSNFSWTGATTYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 3845 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGSATKSALRFSQAGASDIRDQSRNWLPGPCYRQQRVSKQSGQNNNSDFSWTGATKYHLNGRDSLVNPGPAMASHKDDEGKFFPQSGVLIFGKEGSNKTNIDIDRVMITDEEEIRTTNPVATEQYGSVSTNLQAGNAQAATADVN

SEQ ID NO: 3846 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSGGRSNVEIDQVMITDEEEIRTTNPVATEQYGSVSTNLQAGNAQAATADVN

SEQ ID NO: 3847 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPSNRAAIEIVD

SEQ ID NO: 3848 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGHVTTSKLNFSQAGASDIRDQSRNWLPGPCYRQQRVSTTYNGNNNSDFSWTGATKYHLNGRDSLVNPGPAMASHKDDDGKFFPQSGVLIFGKESARKTDAAIDDVMITDEEEIRTTNPVATEQYGSVSTNLQAGNAQAATADVN

SEQ ID NO: 3849 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPRSGAAFTDVH

SEQ ID NO: 3850 - protein, 334 aa, Artificial Sequence; identical to SEQ ID NO: 75
  Synthetic

SEQ ID NO: 3851 - protein, 334 aa, Artificial Sequence; identical to SEQ ID NO: 446
  Synthetic

SEQ ID NO: 3852 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNSGKNNADVDNVMITDEEEIRTTNPVATEQYGSVSTNLQAGNAQAATADVN

SEQ ID NO: 3853 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 3854 - protein, 334 aa, Artificial Sequence; identical to SEQ ID NO: 599
  Synthetic

SEQ ID NO: 3855 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAPQDRAADTNVT

SEQ ID NO: 3856 - protein, 334 aa, Artificial Sequence; identical to SEQ ID NO: 2339
  Synthetic

SEQ ID NO: 3857 - protein, 334 aa, Artificial Sequence; identical to SEQ ID NO: 1414
  Synthetic

SEQ ID NO: 3858 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGIATKSELLFSQAGASDIRDQSRNWLPGPCYRQQRVSKQPNDNNNSEFSWTGATTYHLNGRDSLVNPGPAMASHKDDNEKFFPQSGVLIFGKEDGKGNNVAFDEVMITDEEEIRTTNPVATEQYGSVSTNLQAGNAQAATADVN

SEQ ID NO: 3859 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 3860 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRDPAADTIVP

SEQ ID NO: 3861 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDAEKFFPQSGVLIFGKQGSEKTNVDIEKVMITDEEEIRTTNPVATEQYGSVSTNLQAGNAQAATADVN

SEQ ID NO: 3862 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGQDRAADANVA

SEQ ID NO: 3863 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNATGLVTTSHLRFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 3864 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNKTMSALRFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 3865 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSTPPGDNNNSDFSWTGATKYHLNGRDSLVNPGPAMASHRDDDDKFFPQSGVLIFGKQDAGGNDVAIDKVMITDEEEIRTTNPVATEQYGSVSTNLQAGNAQAATADVN

SEQ ID NO: 3866 - protein, 334 aa, Artificial Sequence; identical to SEQ ID NO: 560
  Synthetic

SEQ ID NO: 3867 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKQDGSGGNTEIDGVMITDEEEIRTTNPVATEQYGSVSTNLQAGNAQAATADVN

SEQ ID NO: 3868 - protein, 334 aa, Artificial Sequence; identical to SEQ ID NO: 2512
  Synthetic

SEQ ID NO: 3869 - protein, 334 aa, Artificial Sequence; identical to SEQ ID NO: 1320
  Synthetic

SEQ ID NO: 3870 - protein, 334 aa, Artificial Sequence; identical to SEQ ID NO: 125
  Synthetic

SEQ ID NO: 3871 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGRPTTSGLLFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 3872 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGSGRDNIAIDHVMITDEEEIRTTNPVATEQYGSVSTNLQAGNAQAATADVN

SEQ ID NO: 3873 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGNTTISALKFSQAGASDIRDQSRNWLPGPCYRQQRVSKKYTDNNNSNFSWTGATKYHLNGRDSLVNPGPAMASHRDDDEKFFPQSGVLIFGKQGSEKTNVDIEKVMITDEEEIRTTNPVATEQYGSVSTNLQRGNRQAATADVN

SEQ ID NO: 3874 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVEIEKVMITDEEEIRTTNPVATEQYGSVSTNLQTARTTAAFKVVD

SEQ ID NO: 3875 - protein, 334 aa, Artificial Sequence; identical to SEQ ID NO: 2181
  Synthetic

SEQ ID NO: 3876 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGDNNNSEFSWPGATKYHLNGRDSLVNPGPAMASHKDDEEKFFPQSGVLIFGKQSASENNVDIGRVMITDEEEIRTTNPVATEQYGSVSTNLQRGNRQAATADVN

SEQ ID NO: 3877 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDAGGSNTEIDQVMITDEEEIRTTNPVATEQYGSVSTNLQAGNAQAATADVN

SEQ ID NO: 3878 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKENAGTTNVAFDKVMITDEEEIRTTNPVATEQYGSVSTNLQAGNAQAATADVN

SEQ ID NO: 3879 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 3880 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSDRTQAATAAVD

SEQ ID NO: 3881 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKESAEGGNVEIGSVMITDEEEIRTTNPVATEQYGSVSTNLQAGNAQAATADVN

SEQ ID NO: 3882 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGTGKNNAAIGQVMITDEEEIRTTNPVATEQYGSVSTNLQAGNAQAATADVN

SEQ ID NO: 3883 - protein, 334 aa, Artificial Sequence; identical to SEQ ID NO: 902
  Synthetic

SEQ ID NO: 3884 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHRDDEGKFFPQSGVLIFGKQNASENNVDFDRVMITDEEEIRTTNPVATEQYGSVSTNLQRGNRQAATADVN

SEQ ID NO: 3885 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKQGTTTGDTAIDNVMITDEEEIRTTNPVATEQYGSVSTNLQAGNAQAATADVN

SEQ ID NO: 3886 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKQDSETANVDIGEVMITDEEEIRTTNPVATEQYGSVSTNLQAGNAQAATADVN

SEQ ID NO: 3887 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNTGSKTLSRLKFSQAGASDIRDQSRNWLPGPCYRQQRVSKQSDQNNNSEFSWTGATKYHLNGRDSLVNPGPAMASHKDDDDKFFPQSGVLIFGKQDAEKNNVAIEEVMITDEEEIRTTNPVATEQYGSVSTNLQAGNAQAATADVN

SEQ ID NO: 3888 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGGSRNNVEYGEVMITDEEEIRTTNPVATEQYGSVSTNLQAGNAQAATADVN

SEQ ID NO: 3889 - protein, 334 aa, Artificial Sequence; identical to SEQ ID NO: 282
  Synthetic

SEQ ID NO: 3890 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHKDDEEKFFPQSGVLIFGKENGKKDNVAIDGVMITDEEEIRTTNPVATEQYGSVSTNLQAGNAQAATADVN

SEQ ID NO: 3891 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKEGSKASNVAVDHVMITDEEEIRTTNPVATEQYGSVSTNLQAGNAQAATADVN

SEQ ID NO: 3892 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHRDDTGKFFPQSGVLIFGKQDGGKTNVDYEQVMITDEEEIRTTNPVATEQYGSVSTNLQAGNAQAATADVN

SEQ ID NO: 3893 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATKYHLNGRDSLVNPGPAMASHEDDNGKFFPQSGVLIFGKENTTGNNVDIDRVMITDEEEIRTTNPVATEQYGSVSTNLQAGNAQAATADVN

SEQ ID NO: 3894 - protein, 334 aa, Artificial Sequence; identical to SEQ ID NO: 163
  Synthetic

SEQ ID NO: 3895 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEGAEANNTAYEQVMITDEEEIRTTNPVATEQYGSVSTNLQAGNAQAATADVN

SEQ ID NO: 3896 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSKQSGQNNNSDFSWTGATKYHLNGRDSLVNPGPAMASHRDDEDKFFPQSGVLIFGKQDGTGANVEIEEVMITDEEEIRTTNPVATEQYGSVSTNLQAGNAQAATADVN

SEQ ID NO: 3897 - protein, 334 aa, Artificial Sequence; identical to SEQ ID NO: 3674
  Synthetic

SEQ ID NO: 3898 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGAKGTNVAVEKVMITDEEEIRTTNPVATEQYGSVSTNLQAGNAQAATADVN

SEQ ID NO: 3899 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRAHTGAATREVA

SEQ ID NO: 3900 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPSGSTTMSTLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3901 - protein, 334 aa, Artificial Sequence; identical to SEQ ID NO: 99
  Synthetic

SEQ ID NO: 3902 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 3903 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSNFSWTGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 3904 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAQQNPAAIRGVA

SEQ ID NO: 3905 - protein, 334 aa, Artificial Sequence; identical to SEQ ID NO: 352
  Synthetic

SEQ ID NO: 3906 - protein, 334 aa, Artificial Sequence; identical to SEQ ID NO: 308
  Synthetic

SEQ ID NO: 3907 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEPRGNAAIKVVD

SEQ ID NO: 3908 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKEGGGKTNVDFESVMITDEEEIRTTNPVATEQYGSVSTNLQAGNAQAATADVN

SEQ ID NO: 3909 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSDFSWTGATKYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 3910 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHEDDKGKFFPQSGVLIFGKEGSGKDNIAFEQVMITDEEEIRTTNPVATEQYGSVSTNLQAGNAQAATADVN

SEQ ID NO: 3911 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAGGSTTPSRLRFSQAGASDIRDQSRNWLPGPCYRQQRVSTTDNENNNSNFSWTGATKYHLNGRDSLVNPGPAMASHKDDDDKFFPQSGVLIFGKQGAEEGDVEIEKVMITDEEEIRTTNPVATEQYGSVSTNLQAGNAQAATADVN

SEQ ID NO: 3912 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENGGTANIDIGSVMITDEEEIRTTNPVATEQYGSVSTNLQAGNAQAATADVN

SEQ ID NO: 3913 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNRDPAASREVP

SEQ ID NO: 3914 - protein, 334 aa, Artificial Sequence; identical to SEQ ID NO: 573
  Synthetic

SEQ ID NO: 3915 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGIVTLSGLRFSQAGASDIRDQSRNWLPGPCYRQQRVSKQASDNNNSEFSWTGATKYHLNGRDSLVNPGPAMASHKDDEEKFFPQSGVLIFGKQGSEKTNVDIEKVMITDEEEIRTTNPVATEQYGSVSTNLQTRRTEAAFEGVA

SEQ ID NO: 3916 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGPQTNSGLGFSQAGASDIRDQSRNWLPGPCYRQQRVSKTHGDNNNSNFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 3917 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3918 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRTPAAVRDVT

SEQ ID NO: 3919 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSNHNNNSNFSWTGATTYHLNGRDSLVNPGPAMASHKDDEGRFFPQSGVLIFGKQDAGANNAEVGEVMITDEEEIRTTNPVATEQYGSVSTNLQAGNAQAATADVN

SEQ ID NO: 3920 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSSHNNNSDFSWTGATKYHLNGRDSLVNPGPAMASHKDDEEKFFPQSGVLIFGKEGSGGSDIAFEGVMITDEEEIRTTNPVATEQYGSVSTNLQAGNAQAATADVN

SEQ ID NO: 3921 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSASGRATQSRLRFSQAGASDIRDQSRNWLPGPCYRQQRVSKQHNQNNNSEFSWTGATTYHLNGRDSLVNPGPAMASHKDDNEKFFPQSGVLIFGKQGAGADDVEYDEVMITDEEEIRTTNPVATEQYGSVSTNLQAGNAQAATADVN

SEQ ID NO: 3922 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKESSTEDNVDIGRVMITDEEEIRTTNPVATEQYGSVSTNLQAGNAQAATADVN

SEQ ID NO: 3923 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNRQDGAAFSGVT

SEQ ID NO: 3924 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDGKFFPQSGVLIFGKQGSEKTNVDIEKVMITDEEEIRTTNPVATEQYGSVSTNLQAGNAQAATADVN

SEQ ID NO: 3925 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 3926 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADRFFPQSGVLIFGKQSSKATNTEIDSVMITDEEEIRTTNPVATEQYGSVSTNLQAGNAQAATADVN

SEQ ID NO: 3927 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKEGAAGDNIDVERVMITDEEEIRTTNPVATEQYGSVSTNLQAGNAQAATADVN

SEQ ID NO: 3928 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRAPAASETVA

SEQ ID NO: 3929 - protein, 334 aa, Artificial Sequence; identical to SEQ ID NO: 552
  Synthetic

SEQ ID NO: 3930 - protein, 334 aa, Artificial Sequence; identical to SEQ ID NO: 341
  Synthetic

SEQ ID NO: 3931 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHEDDADKFFPQSGVLIFGKQGAEASDADVEQVMITDEEEIRTTNPVATEQYGSVSTNLQAGNAQAATADVN

SEQ ID NO: 3932 - protein, 334 aa, Artificial Sequence; identical to SEQ ID NO: 1605
  Synthetic

SEQ ID NO: 3933 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTQSPAAFASVP

SEQ ID NO: 3934 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDDGKFFPQSGVLIFGKEGAAATNADFGKVMITDEEEIRTTNPVATEQYGSVSTNLQAGNAQAATADVN

SEQ ID NO: 3935 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKESTNKTNVAIERVMITDEEEIRTTNPVATEQYGSVSTNLQAGNAQAATADVN

SEQ ID NO: 3936 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDSTGNNIDIEQVMITDEEEIRTTNPVATEQYGSVSTNLQAGNAQAATADVN

SEQ ID NO: 3937 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRNPAASSAVH

SEQ ID NO: 3938 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEDSRKSNADIEGVMITDEEEIRTTNPVATEQYGSVSTNLQAGNAQAATADVN

SEQ ID NO: 3939 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGIMTTSTLRFSQAGASDIRDQSRNWLPGPCYRQQRVSKTSADNNNSNFSWTGATKYHLNGRDSLVNPGPAMASHRDDNDKFFPQSGVLIFGKENAGKNDVEIDHVMITDEEEIRTTNPVATEQYGSVSTNLQAGNAQAATADVN

SEQ ID NO: 3940 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESSDRNNVDIEQVMITDEEEIRTTNPVATEQYGSVSTNLQAGNAQAATADVN

SEQ ID NO: 3941 - protein, 334 aa, Artificial Sequence; identical to SEQ ID NO: 624
  Synthetic

SEQ ID NO: 3942 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDEKFFPQSGVLIFGKEGAAGDNTAIEGVMITDEEEIRTTNPVATEQYGSVSTNLQAGNAQAATADVN

SEQ ID NO: 3943 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKSGLATKSNLGFSQAGASDIRDQSRNWLPGPCYRQQRVSTTPNENNNSDFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3944 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDGGTTTKSQLRFSQAGASDIRDQSRNWLPGPCYRQQRVSTKDDRNNNSDFSWTGATKYHLNGRDSLVNPGPAMASHKDDDDRFFPQSGVLIFGKQGGGATDVEIGNVMITDEEEIRTTNPVATEQYGSVSTNLQAGNAQAATADVN

SEQ ID NO: 3945 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYGDNNNSDFSWPGATTYHLNGRDSLVNPGPAMASHRDDNDKFFPQSGVLIFGKQGTGRADVAIDEVMITDEEEIRTTNPVATEQYGSVSTNLQAGNAQAATADVN

SEQ ID NO: 3946 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTDKFFPQSGVLIFGKQGSEKTNVDIEKVMITDEEEIRTTNPVATEQYGSVSTNLQAGNAQAATADVN

SEQ ID NO: 3947 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 3948 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGNDTLSQLRFSQAGASDIRDQSRNWLPGPCYRQQRVSKQSGDNNNSNFSWTGATTYHLNGRDSLVNPGPAMASHEDDNGKFFPQSGVLIFGKQNAGATDVDIGSVMITDEEEIRTTNPVATEQYGSVSTNLQAGNAQAATADVN

SEQ ID NO: 3949 - protein, 334 aa, Artificial Sequence; identical to SEQ ID NO: 657
  Synthetic

SEQ ID NO: 3950 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDTGKFFPQSGVLIFGKESANKTNIDIEHVMITDEEEIRTTNPVATEQYGSVSTNLQAGNAQAATADVN

SEQ ID NO: 3951 - protein, 334 aa, Artificial Sequence; identical to SEQ ID NO: 394
  Synthetic

SEQ ID NO: 3952 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGHMTPSRLQFSQAGASDIRDQSRNWLPGPCYRQQRVSKTDNHNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 3953 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDDDRFFPQSGVLIFGKESGGTDDADIDEVMITDEEEIRTTNPVATEQYGSVSTNLQAGNAQAATADVN

SEQ ID NO: 3954 - protein, 334 aa, Artificial Sequence; identical to SEQ ID NO: 206
  Synthetic

SEQ ID NO: 3955 - protein, 334 aa, Artificial Sequence; identical to SEQ ID NO: 2262
  Synthetic

SEQ ID NO: 3956 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNEKFFPQSGVLIFGKEGASKNNIEIGSVMITDEEEIRTTNPVATEQYGSVSTNLQAGNAQAATADVN

SEQ ID NO: 3957 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNHNNNSNFSWTGATTYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 3958 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDTQNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3959 - protein, 334 aa, Artificial Sequence; identical to SEQ ID NO: 3705
  Synthetic

SEQ ID NO: 3960 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPGRNNNSDFSWTGATKYHLNGRDSLVNPGPAMASHKDDDEKFFPQSGVLIFGKEGGDGSNVDFERVMITDEEEIRTTNPVATEQYGSVSTNLQAGNAQAATADVN

SEQ ID NO: 3961 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNQRTHAANNMVD

SEQ ID NO: 3962 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTTSNHNNNSNFSWTGATTYHLNGRDSLVNPGPAMASHKDDEGRFFPQSGVLIFGKQDAGANNAEVDHVMITDEEEIRTTNPVATEQYGSVSTNLQAGNAQAATADVN

SEQ ID NO: 3963 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSQTKSELQFSQAGASDIRDQSRNWLPGPCYRQQRVSKKYTDNNNSNFSWTGATTYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 3964 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTENNNSEFSWTGATTYHLNGRDSLVNPGPAMASHKDDNGRFFPQSGVLIFGKQGAATDNAAIDQVMITDEEEIRTTNPVATEQYGSVSTNLQAGNAQAATADVN

SEQ ID NO: 3965 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGSTTMSKLMFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 3966 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKENASGGNAEIDSVMITDEEEIRTTNPVATEQYGSVSTNLQAGNAQAATADVN

SEQ ID NO: 3967 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSKTDGENNNSDFSWTGATKYHLNGRDSLVNPGPAMASHKDDDDKFFPQSGVLIFGKQSASKNNIAIEEVMITDEEEIRTTNPVATEQYGSVSTNLQAGNAQAATADVN

SEQ ID NO: 3968 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGHNTKSGLQFSQAGASDIRDQSRNWLPGPCYRQQRVSTKDDRNNNSDFSWTGATKYHLNGRDSLVNPGPAMASHKDDDDRFFPQSGVLIFGKEDAGTTNVAFDKVMITDEEEIRTTNPVATEQYGSVSTNLQAGNAQAATADVN

SEQ ID NO: 3969 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGSNHAAAKEVH

SEQ ID NO: 3970 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQTQKSEAAFRTVH

SEQ ID NO: 3971 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKAGSETNSRLKFSQAGASDIRDQSRNWLPGPCYRQQRVSTTAGDNNNSNFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 3972 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAKGGPTTHSRLGFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 3973 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSKKHDHNNNSEFSWTGATKYHLNGRDSLVNPGPAMASHRDDEDKFFPQSGVLIFGKQGAEANNVAFEDVMITDEEEIRTTNPVATEQYGSVSTNLQAGNAQAATADVN

SEQ ID NO: 3974 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEGGARTDVEIGEVMITDEEEIRTTNPVATEQYGSVSTNLQAGNAQAATADVN

SEQ ID NO: 3975 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDEEKFFPQSGVLIFGKQGSEKTNVDIEKVMITDEEEIRTTNPVATEQYGSVSTNLQGPRTTAAVDAVT

SEQ ID NO: 3976 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDHNNNSNFSWTGATKYHLNGRDSLVNPGPAMASHKDDDDKFFPQSGVLIFGKQSAKAANAAIDEVMITDEEEIRTTNPVATEQYGSVSTNLQAGNAQAATADVN

SEQ ID NO: 3977 - protein, 334 aa, Artificial Sequence; identical to SEQ ID NO: 600
  Synthetic

SEQ ID NO: 3978 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTENNNSDFSWTGATKYHLNGRDSLVNPGPAMASHKDDEEKFFPQSGVLIFGKQNGSTTNVDIGGVMITDEEEIRTTNPVATEQYGSVSTNLQAGNAQAATADVN

SEQ ID NO: 3979 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPTHNNNSNFSWTGATKYHLNGRDSLVNPGPAMASHRDDDDKFFPQSGVLIFGKQNGGKNDVDIEQVMITDEEEIRTTNPVATEQYGSVSTNLQAGNAQAATADVN

SEQ ID NO: 3980 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTAGRNNNSEFSWTGATTYHLNGRDSLVNPGPAMASHKDDTEKFFPQSGVLIFGKQGSEKTNVDIEKVMITDEEEIRTTNPVATEQYGSVSTNLQAGNAQAATADVN

SEQ ID NO: 3981 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGSVTKSHLMFSQAGASDIRDQSRNWLPGPCYRQQRVSKTSADNNNSDFSWTGATKYHLNGRDSLVNPGPAMASHKDDDERFFPQSGVLIFGKQSAKAANAAIDEVMITDEEEIRTTNPVATEQYGSVSTNLQAGNAQAATADVN

SEQ ID NO: 3982 - protein, 334 aa, Artificial Sequence; identical to SEQ ID NO: 1564
  Synthetic

SEQ ID NO: 3983 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRDQAAVRMVT

SEQ ID NO: 3984 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3985 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKQPTGNNNSNFSWTGATKYHLNGRDSLVNPGPAMASHEDDTGKFFPQSGVLIFGKQGSEKTNVDIEKVMITDEEEIRTTNPVATEQYGSVSTNLQAGNAQAATADVN

SEQ ID NO: 3986 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSNANDVAYEGVMITDEEEIRTTNPVATEQYGSVSTNLQAGNAQAATADVN

SEQ ID NO: 3987 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGATGTNIDFERVMITDEEEIRTTNPVATEQYGSVSTNLQAGNAQAATADVN

SEQ ID NO: 3988 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDDGNNNSNFSWPGATKYHLNGRDSLVNPGPAMASHRDDDDKFFPQSGVLIFGKENSEKANVEVGEVMITDEEEIRTTNPVATEQYGSVSTNLQAGNAQAATADVN

SEQ ID NO: 3989 - protein, 334 aa, Artificial Sequence; identical to SEQ ID NO: 810
  Synthetic

SEQ ID NO: 3990 - protein, 334 aa, Artificial Sequence; identical to SEQ ID NO: 3572
  Synthetic

SEQ ID NO: 3991 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKAGHTTPSHLGFSQAGASDIRDQSRNWLPGPCYRQQRVSKQPSQNNNSDFSWTGATKYHLNGRDSLVNPGPAMASHKDDEDKFFPQSGVLIFGKQGSEKTNVDIDKVMITDEEEIRTTNPVATEQYGSVSTNLQAGNAQAATADVN

SEQ ID NO: 3992 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQGSTKGNVAIEQVMITDEEEIRTTNPVATEQYGSVSTNLQAGNAQAATADVN

SEQ ID NO: 3993 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGHDTTSELRFSQAGASDIRDQSRNWLPGPCYRQQRVSTTPGGNNNSNFSWTGATKYHLNGRDSLVNPGPAMASHKDDDDRFFPQSGVLIFGKESAKTSDAAVDDVMITDEEEIRTTNPVATEQYGSVSTNLQAGNAQAATADVN

SEQ ID NO: 3994 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRQNGAAFAAVT

SEQ ID NO: 3995 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHRDDDEKFFPQSGVLIFGKQDSEKTNVDIEKVMITDEEEIRTTNPVATEQYGSVSTNLQAGNAQAATADVN

SEQ ID NO: 3996 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKEGSGKANVAIDKVMITDEEEIRTTNPVATEQYGSVSTNLQAGNAQAATADVN

SEQ ID NO: 3997 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGTGTMTKSQLGFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 3998 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGHLTTSALRFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 3999 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTGNNNSNFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 4000 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSTKPSGNNNSDFSWTGATKYHLNGRDSLVNPGPAMASHKDDDEKFFPQSGVLIFGKQDARGNDVEFGEVMITDEEEIRTTNPVATEQYGSVSTNLQAGNAQAATADVN

SEQ ID NO: 4001 - protein, 334 aa, Artificial Sequence; identical to SEQ ID NO: 3002
  Synthetic

SEQ ID NO: 4002 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQASGNNNSEFSWTGATKYHLNGRDSLVNPGPAMASHKDDDDRFFPQSGVLIFGKESGEKNNIDIDGVMITDEEEIRTTNPVATEQYGSVSTNLQAGNAQAATADVN

SEQ ID NO: 4003 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEDAGKTNIDIGQVMITDEEEIRTTNPVATEQYGSVSTNLQAGNAQAATADVN

SEQ ID NO: 4004 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGRFFPQSGVLIFGKQGSTGTNTDIGQVMITDEEEIRTTNPVATEQYGSVSTNLQAGNAQAATADVN

SEQ ID NO: 4005 - protein, 334 aa, Artificial Sequence; identical to SEQ ID NO: 1950
  Synthetic

SEQ ID NO: 4006 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWPGATTYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 4007 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGRRDPAADTIVP

SEQ ID NO: 4008 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKQSADGSDVDIDRVMITDEEEIRTTNPVATEQYGSVSTNLQAGNAQAATADVN

SEQ ID NO: 4009 - protein, 334 aa, Artificial Sequence; identical to SEQ ID NO: 1679
  Synthetic

SEQ ID NO: 4010 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDNDKFFPQSGVLIFGKEDSRKSNADIEGVMITDEEEIRTTNPVATEQYGSVSTNLQAGNAQAATADVN

SEQ ID NO: 4011 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQYTDNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 4012 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEEKFFPQSGVLIFGKQGSEKTNVDIEKVMITDEEEIRTTNPVATEQYGSVSTNLQSRNDRAAFNGVT

SEQ ID NO: 4013 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGRAGAASTIVH

SEQ ID NO: 4014 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKTHGDNNNSNFSWTGATTYHLNGRDSLVNPGPAMASHKDDAEKFFPQSGVLIFGKQGAGANNVDFGEVMITDEEEIRTTNPVATEQYGSVSTNLQAGNAQAATADVN

SEQ ID NO: 4015 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGHMTLSGLRFSQAGASDIRDQSRNWLPGPCYRQQRVSTKDDRNNNSDFSWTGATKYHLNGRDSLVNPGPAMASHKDDDDRFFPQSGVLIFGKQGSTGTDVAYEGVMITDEEEIRTTNPVATEQYGSVSTNLQAGNAQAATADVN

SEQ ID NO: 4016 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNKTLSRLKFSQAGASDIRDQSRNWLPGPCYRQQRVSTQASGNNNSEYSWTGATKYHLNGRDSLVNPGPAMASHKDDDDRFFPQSGVLIFGKEDSRKSNADIEGVMITDEEEIRTTNPVATEQYGSVSTNLQAGNAQAATADVN

SEQ ID NO: 4017 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNATSGTNTTSRLGFSQAGASDIRDQSRNWLPGPCYRQQRVSKQPGDNNNSNFSWTGATKYHLNGRDSLVNPGPAMASHKDDEEKFFPQSGVLIFGKEDGSGTDIDFEGVMITDEEEIRTTNPVATEQYGSVSTNLQAGNAQAATADVN

SEQ ID NO: 4018 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNQGGTTTPSKLIFSQAGASDIRDQSRNWLPGPCYRQQRVSKQSDRNNNSEFSWTGATKYHLNGRDSLVNPGPAMASHKDDEDKFFPQSGVLIFGKESGGKGDADFEGVMITDEEEIRTTNPVATEQYGSVSTNLQAGNAQAATADVN

SEQ ID NO: 4019 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHRDDEGKFFPQSGVLIFGKEGGSTSDAEFDQVMITDEEEIRTTNPVATEQYGSVSTNLQAGNAQAATADVN

SEQ ID NO: 4020 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDTEKFFPQSGVLIFGKQSAKAANAAIDEVMITDEEEIRTTNPVATEQYGSVSTNLQAGNAQAATADVN

SEQ ID NO: 4021 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQNGRKTDAEVEHVMITDEEEIRTTNPVATEQYGSVSTNLQAGNAQAATADVN

SEQ ID NO: 4022 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSDFSWTGATKYHLNGRDSLVNPGPAMASHKDDEEKFFPQSGVLIFGKENSKGGDVAFDNVMITDEEEIRTTNPVATEQYGSVSTNLQAGNAQAATADVN

SEQ ID NO: 4023 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKQNSGATDVAIGGVMITDEEEIRTTNPVATEQYGSVSTNLQAGNAQAATADVN

SEQ ID NO: 4024 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPSGITTMSALGFSQAGASDIRDQSRNWLPGPCYRQQRVSKTSADNNNSEYSWTGATKYHLNGRDSLVNPGPAMASHKDDEGRFFPQSGVLIFGKEGAGGNNVEIDDVMITDEEEIRTTNPVATEQYGSVSTNLQAGNAQAATADVN

SEQ ID NO: 4025 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDDKFFPQSGVLIFGKEGAGKTNTAVGNVMITDEEEIRTTNPVATEQYGSVSTNLQAGNAQAATADVN

SEQ ID NO: 4026 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGRFFPQSGVLIFGKQGSEKTNVDIEKVMITDEEEIRTTNPVATEQYGSVSTNLQAGNAQAATADVN

SEQ ID NO: 4027 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGHPTTSQLRFSQAGASDIRDQSRNWLPGPCYRQQRVSTKDTDNNNSNFSWTGATKYHLNGRDSLVNPGPAMASHRDDEDKFFPQSGVLIFGKQGGGATDVEIGNVMITDEEEIRTTNPVATEQYGSVSTNLQAGNAQAATADVN

SEQ ID NO: 4028 - protein, 334 aa, Artificial Sequence; identical to SEQ ID NO: 1355
  Synthetic

SEQ ID NO: 4029 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTAGDNNNSNFSWTGATTYHLNGRDSLVNPGPAMASHKDDEEKFFPQSGVLIFGKQDSGGGDVEVDEVMITDEEEIRTTNPVATEQYGSVSTNLQAGNAQAATADVN

SEQ ID NO: 4030 - protein, 334 aa, Artificial Sequence; identical to SEQ ID NO: 625
  Synthetic

SEQ ID NO: 4031 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDAEKFFPQSGVLIFGKQGSEKTNVDIEKVMITDEEEIRTTNPVATEQYGSVSTNLQRGNRQAATADVN

SEQ ID NO: 4032 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGASNGAAVDIVH

SEQ ID NO: 4033 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4034 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGTGRDTMSALLFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 4035 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTDRAGAASTDVQ

SEQ ID NO: 4036 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKTDGENNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 4037 - protein, 334 aa, Artificial Sequence; identical to SEQ ID NO: 2717
  Synthetic

SEQ ID NO: 4038 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQADRSGAAISVVQ

SEQ ID NO: 4039 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGGGKTNVDFDKVMITDEEEIRTTNPVATEQYGSVSTNLQAGNAQAATADVN

SEQ ID NO: 4040 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTATDNNNSNFSWTGATTYHLNGRDSLVNPGPAMASHKDDDGKFFPQSGVLIFGKEGTGKGDVAIGEVMITDEEEIRTTNPVATEQYGSVSTNLQAGNAQAATADVN

SEQ ID NO: 4041 - protein, 334 aa, Artificial Sequence; identical to SEQ ID NO: 3456
  Synthetic

SEQ ID NO: 4042 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEDAGGNNIDVDRVMITDEEEIRTTNPVATEQYGSVSTNLQAGNAQAATADVN

SEQ ID NO: 4043 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHGDDTDRFFPQSGVLIFGKEGAGGNNVEIDDVMITDEEEIRTTNPVATEQYGSVSTNLQAGNAQAATADVN

SEQ ID NO: 4044 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGSTTPSRLQFSQAGASDIRDQSRNWLPGPCYRQQRVSKVSADNNNSEFSWTGATKYHLNGRDSLVNPGPAMASHKDDEEKFFPQSGVLIFGKEDAGGSNAEYDKVMITDEEEIRTTNPVATEQYGSVSTNLQAGNAQAATADVN

SEQ ID NO: 4045 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQNGSASNVAIDNVMITDEEEIRTTNPVATEQYGSVSTNLQAGNAQAATADVN

SEQ ID NO: 4046 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTKTMSQLNFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4047 - protein, 334 aa, Artificial Sequence; identical to SEQ ID NO: 200
  Synthetic

SEQ ID NO: 4048 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENATAGDAAIGDVMITDEEEIRTTNPVATEQYGSVSTNLQAGNAQAATADVN

SEQ ID NO: 4049 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATTYHLNGRDSLVNPGPAMASHGDDDERFFPQSGVLIFGKQGSEKTNVDIEKVMITDEEEIRTTNPVATEQYGSVSTNLQAGNAQAATADVN

SEQ ID NO: 4050 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTSADNNNSEYSWTGATKYHLNGRDSLVNPGPAMASHKDDEEKFFPQSGVLIFGKEDAGANDVAVEHVMITDEEEIRTTNPVATEQYGSVSTNLQAGNAQAATADVN

SEQ ID NO: 4051 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNRTPAANQVVQ

SEQ ID NO: 4052 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDRFFPQSGVLIFGKQGAAKDNIAIEKVMITDEEEIRTTNPVATEQYGSVSTNLQAGNAQAATADVN

SEQ ID NO: 4053 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTDRFFPQSGVLIFGKEGAGGNNVEIDSVMITDEEEIRTTNPVATEQYGSVSTNLQRGNRQAATADVN

SEQ ID NO: 4054 - protein, 334 aa, Artificial Sequence; identical to SEQ ID NO: 1195
  Synthetic

SEQ ID NO: 4055 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRQGNAAIGVVN

SEQ ID NO: 4056 - protein, 334 aa, Artificial Sequence; identical to SEQ ID NO: 610
  Synthetic

SEQ ID NO: 4057 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQAGNAQAATADVN

SEQ ID NO: 4058 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQNGRTGDADVEQVMITDEEEIRTTNPVATEQYGSVSTNLQAGNAQAATADVN

SEQ ID NO: 4059 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQRDQAAAQTVQ

SEQ ID NO: 4060 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGRNPAAVKEVQ

SEQ ID NO: 4061 - protein, 334 aa, Artificial Sequence; identical to SEQ ID NO: 897
  Synthetic

SEQ ID NO: 4062 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKQGATAANVAVDNVMITDEEEIRTTNPVATEQYGSVSTNLQAGNAQAATADVN

SEQ ID NO: 4063 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATKYHLNGRDSLVNPGPAMASHRDDDDKFFPQSGVLIFGKQGAAETDVDIENVMITDEEEIRTTNPVATEQYGSVSTNLQAGNAQAATADVN

SEQ ID NO: 4064 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 4065 - protein, 334 aa, Artificial Sequence; identical to SEQ ID NO: 576
  Synthetic

SEQ ID NO: 4066 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLLFSQAGASDIRDQSRNWLPGPCYRQQRVSKQASDNNNSEFSWTGATKYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 4067 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTTSTLQFSQAGASDIRDQSRNWLPGPCYRQQRVSKKYTDNNNSNFSWTGATTYHLNGRDSLVNPGPAMASHRDDAGRFFPQSGVLIFGKQGSEKTNVDIEKVMITDEEEIRTTNPVATEQYGSVSTNLQAGNAQAATADVN

SEQ ID NO: 4068 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGSATKSALRFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4069 - protein, 334 aa, Artificial Sequence; identical to SEQ ID NO: 898
  Synthetic

SEQ ID NO: 4070 - protein, 334 aa, Artificial Sequence; identical to SEQ ID NO: 73
  Synthetic

SEQ ID NO: 4071 - protein, 334 aa, Artificial Sequence; identical to SEQ ID NO: 31
  Synthetic

SEQ ID NO: 4072 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQERRNPAAFATVT

SEQ ID NO: 4073 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQYTDNNNSNFSWTGATTYHLNGRDSLVNPGPAMASHRDDEDKFFPQSGVLIFGKENGGAADVAIENVMITDEEEIRTTNPVATEQYGSVSTNLQAGNAQAATADVN

SEQ ID NO: 4074 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKQDAENNNSEFSWPGATKYHLNGRDSLVNPGPAMASHKDDEEKFFPQSGVLIFGKEGGKGSDVDIGGVMITDEEEIRTTNPVATEQYGSVSTNLQAGNAQAATADVN

SEQ ID NO: 4075 - protein, 334 aa, Artificial Sequence; identical to SEQ ID NO: 3047
  Synthetic

SEQ ID NO: 4076 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGNMTKSTLEFSQAGASDIRDQSRNWLPGPCYRQQRVSKTHGDNNNSNFSWTGATTYHLNGRDSLVNPGPAMASHRDDDDKFFPQSGVLIFGKQSAKAANAAIDEVMITDEEEIRTTNPVATEQYGSVSTNLQAGNAQAATADVN

SEQ ID NO: 4077 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4078 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNNTISSLGFSQAGASDIRDQSRNWLPGPCYRQQRVSKTAGRNNNSDFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 4079 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGTLTNSRLRFSQAGASDIRDQSRNWLPGPCYRQQRVSKQSDRNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4080 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGHNTKSGLKFSQAGASDIRDQSRNWLPGPCYRQQRVSKTPDRNNNSEFSWTGATTYHLNGRDSLVNPGPAMASHKDDEEKFFPQSGVLIFGKQDAGGNDVAIDKVMITDEEEIRTTNPVATEQYGSVSTNLQAGNAQAATADVN

SEQ ID NO: 4081 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4082 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKQSTREGDVDIENVMITDEEEIRTTNPVATEQYGSVSTNLQAGNAQAATADVN

SEQ ID NO: 4083 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRDPAADTIVP

SEQ ID NO: 4084 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNRNNNSNFSWTGATKYHLNGRDSLVNPGPAMASHKDDDEKFFPQSGVLIFGKEGAGANDVAYENVMITDEEEIRTTNPVATEQYGSVSTNLQAGNAQAATADVN

SEQ ID NO: 4085 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGSHTTSKLVFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4086 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 4087 - protein, 334 aa, Artificial Sequence; identical to SEQ ID NO: 503
  Synthetic

SEQ ID NO: 4088 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPNNAAAFRIVT

SEQ ID NO: 4089 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSKTSADNNNSDFSWTGATKYHLNGRDSLVNPGPAMASHKDDEEKFFPQSGVLIFGKQSSKATNTEIDSVMITDEEEIRTTNPVATEQYGSVSTNLQAGNAQAATADVN

SEQ ID NO: 4090 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTNTSAADQDVT

SEQ ID NO: 4091 - protein, 334 aa, Artificial Sequence; identical to SEQ ID NO: 1719
  Synthetic

SEQ ID NO: 4092 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGSGKSDAAIGDVMITDEEEIRTTNPVATEQYGSVSTNLQAGNAQAATADVN

SEQ ID NO: 4093 - protein, 334 aa, Artificial Sequence; identical to SEQ ID NO: 797
  Synthetic

SEQ ID NO: 4094 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4095 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSRLSFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4096 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGGEKADVAIDEVMITDEEEIRTTNPVATEQYGSVSTNLQAGNAQAATADVN

SEQ ID NO: 4097 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQNGSTTNVDIGGVMITDEEEIRTTNPVATEQYGSVSTNLQAGNAQAATADVN

SEQ ID NO: 4098 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPDQNNNSEFSWTGATKYHLNGRDSLVNPGPAMASHRDDEDKFFPQSGVLIFGKQDANRNNVEIGQVMITDEEEIRTTNPVATEQYGSVSTNLQAGNAQAATADVN

SEQ ID NO: 4099 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGSNTMSRLKFSQAGASDIRDQSRNWLPGPCYRQQRVSKTDGENNNSNFSWTGATKYHLNGRDSLVNPGPAMASHKDDEEKFFPQSGVLIFGKQNSGKNNIDVEGVMITDEEEIRTTNPVATEQYGSVSTNLQAGNAQAATADVN

SEQ ID NO: 4100 - protein, 334 aa, Artificial Sequence; identical to SEQ ID NO: 2902
  Synthetic

SEQ ID NO: 4101 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 4102 - protein, 334 aa, Artificial Sequence; identical to SEQ ID NO: 348
  Synthetic

SEQ ID NO: 4103 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESAGETDAAIDEVMITDEEEIRTTNPVATEQYGSVSTNLQAGNAQAATADVN

SEQ ID NO: 4104 - protein, 334 aa, Artificial Sequence; identical to SEQ ID NO: 942
  Synthetic

SEQ ID NO: 4105 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTSADNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4106 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTATNSRLRFSQAGASDIRDQSRNWLPGPCYRQQRVSKKYTDNNNSNFSWTGATTYHLNGRDSLVNPGPAMASHRDDEDKFFPQSGVLIFGKQGSGKDNVEVGQVMITDEEEIRTTNPVATEQYGSVSTNLQAGNAQAATADVN

SEQ ID NO: 4107 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKTGSLTQSRLQFSQAGASDIRDQSRNWLPGPCYRQQRVSKVSADNNNSEYSWTGATKYHLNGRDSLVNPGPAMASHKDDDDRFFPQSGVLIFGKEGAGKTDVAIDGVMITDEEEIRTTNPVATEQYGSVSTNLQAGNAQAATADVN

SEQ ID NO: 4108 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEPHAGAADNTVH

SEQ ID NO: 4109 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDKQGTAAFRAVN

SEQ ID NO: 4110 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGRVTPSRLGFSQAGASDIRDQSRNWLPGPCYRQQRVSKQPTGNNNSNFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4111 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGSPTTSNLGFSQAGASDIRDQSRNWLPGPCYRQQRVSKQSGDNNNSEFSWTGATKYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 4112 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAHTGLKTNSRLGFSQAGASDIRDQSRNWLPGPCYRQQRVSTTPADNNNSDFSWTGATKYHLNGRDSLVNPGPAMASHKDDEGRFFPQSGVLIFGKQDAGATDVAVEEVMITDEEEIRTTNPVATEQYGSVSTNLQAGNAQAATADVN

SEQ ID NO: 4113 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENGKAGDVDIGNVMITDEEEIRTTNPVATEQYGSVSTNLQAGNAQAATADVN

SEQ ID NO: 4114 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4115 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKDRTHAAFDMVN

SEQ ID NO: 4116 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKEGTGTTDAAVDDVMITDEEEIRTTNPVATEQYGSVSTNLQAGNAQAATADVN

SEQ ID NO: 4117 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGSLTQSRLRFSQAGASDIRDQSRNWLPGPCYRQQRVSKQPAGNNNSEFSWTGATKYHLNGRDSLVNPGPAMASHRDDEDKFFPQSGVLIFGKQGSAASNADVGQVMITDEEEIRTTNPVATEQYGSVSTNLQAGNAQAATADVN

SEQ ID NO: 4118 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGRFFPQSGVLIFGKQNAERANTDIGKVMITDEEEIRTTNPVATEQYGSVSTNLQAGNAQAATADVN

SEQ ID NO: 4119 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKQGGGKNNIDIDRVMITDEEEIRTTNPVATEQYGSVSTNLQAGNAQAATADVN

SEQ ID NO: 4120 - protein, 334 aa, Artificial Sequence; identical to SEQ ID NO: 310
  Synthetic

SEQ ID NO: 4121 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKQDAENNNSEFSWPGATKYHLNGRDSLVNPGPAMASHKDDEEKFFPQSGVLIFGKEGGKGSDVDIGGVMITDEEEIRTTNPVATEQYGSVSTNLQRGNRQAATADVN

SEQ ID NO: 4122 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 4123 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQGAKKADTDIGNVMITDEEEIRTTNPVATEQYGSVSTNLQAGNAQAATADVN

SEQ ID NO: 4124 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHRDDDEKFFPQSGVLIFGKEGSRRDNAAIEHVMITDEEEIRTTNPVATEQYGSVSTNLQAGNAQAATADVN

SEQ ID NO: 4125 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNKTLSRLKFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4126 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKEGASKNNIAIEEVMITDEEEIRTTNPVATEQYGSVSTNLQAGNAQAATADVN

SEQ ID NO: 4127 - protein, 334 aa, Artificial Sequence; identical to SEQ ID NO: 2641
  Synthetic

SEQ ID NO: 4128 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGASTSDVAFDSVMITDEEEIRTTNPVATEQYGSVSTNLQAGNAQAATADVN

SEQ ID NO: 4129 - protein, 334 aa, Artificial Sequence; identical to SEQ ID NO: 156
  Synthetic

SEQ ID NO: 4130 - protein, 334 aa, Artificial Sequence; identical to SEQ ID NO: 2122
  Synthetic

SEQ ID NO: 4131 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGLVTNSQLSFSQAGASDIRDQSRNWLPGPCYRQQRVSKTSADNNNSNFSWTGATTYHLNGRDSLVNPGPAMASHRDDDERFFPQSGVLIFGKEGAAKANVDIGDVMITDEEEIRTTNPVATEQYGSVSTNLQAGNAQAATADVN

SEQ ID NO: 4132 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSQTKSELQFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 4133 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNSRATAASAGVH

SEQ ID NO: 4134 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDDRFFPQSGVLIFGKENTSENDIEIDRVMITDEEEIRTTNPVATEQYGSVSTNLQAGNAQAATADVN

SEQ ID NO: 4135 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGRFFPQSGVLIFGKQGSEKTNVDIEKVMITDEEEIRTTNPVATEQYGSVSTNLQAGNAQAATADVN

SEQ ID NO: 4136 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTATMSKLHFSQAGASDIRDQSRNWLPGPCYRQQRVSKQPGDNNNSNFSWTGATKYHLNGRDSLVNPGPAMASHKDDDDRFFPQSGVLIFGKEGANGTNVEIGKVMITDEEEIRTTNPVATEQYGSVSTNLQAGNAQAATADVN

SEQ ID NO: 4137 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNHKGGAATAVVT

SEQ ID NO: 4138 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNITKSELRFSQAGASDIRDQSRNWLPGPCYRQQRVSKTDGENNNSDFSWTGATKYHLNGRDSLVNPGPAMASHKDDEEKFFPQSGVLIFGKESTDGGNVAIDSVMITDEEEIRTTNPVATEQYGSVSTNLQAGNAQAATADVN

SEQ ID NO: 4139 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSRTSDADFESVMITDEEEIRTTNPVATEQYGSVSTNLQAGNAQAATADVN

SEQ ID NO: 4140 - protein, 334 aa, Artificial Sequence; identical to SEQ ID NO: 2304
  Synthetic

SEQ ID NO: 4141 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGSVTKSHLMFSQAGASDIRDQSRNWLPGPCYRQQRVSTQSTGNNNSDFSWTGATKYHLNGRDSLVNPGPAMASHKDDDDRFFPQSGVLIFGKEGSAASNVDIGGVMITDEEEIRTTNPVATEQYGSVSTNLQAGNAQAATADVN

SEQ ID NO: 4142 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 4143 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGTTGANIDFDGVMITDEEEIRTTNPVATEQYGSVSTNLQAGNAQAATADVN

SEQ ID NO: 4144 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKTSADNNNSNFSWTGATTYHLNGRDSLVNPGPAMASHKDDEDKFFPQSGVLIFGKQSASENNVDIGRVMITDEEEIRTTNPVATEQYGSVSTNLQAGNAQAATADVN

SEQ ID NO: 4145 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRSGAAFTGVN

SEQ ID NO: 4146 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDDDKFFPQSGVLIFGKESGGKSNAAIGQVMITDEEEIRTTNPVATEQYGSVSTNLQAGNAQAATADVN

SEQ ID NO: 4147 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGTGGPTTQSKLQFSQAGASDIRDQSRNWLPGPCYRQQRVSKTSNGNNNSEFSWTGATKYHLNGRDSLVNPGPAMASHRDDDDKFFPQSGVLIFGKEGAGKTNIAVDRVMITDEEEIRTTNPVATEQYGSVSTNLQAGNAQAATADVN

SEQ ID NO: 4148 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQNAEANNVAIGEVMITDEEEIRTTNPVATEQYGSVSTNLQAGNAQAATADVN

SEQ ID NO: 4149 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSQRDKAAFESVT

SEQ ID NO: 4150 - protein, 334 aa, Artificial Sequence; identical to SEQ ID NO: 1354
  Synthetic

SEQ ID NO: 4151 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 4152 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKKDDGNNNSNFSWTGATTYHLNGRDSLVNPGPAMASHGDDNGKFFPQSGVLIFGKEGAAANNVEIDGVMITDEEEIRTTNPVATEQYGSVSTNLQAGNAQAATADVN

SEQ ID NO: 4153 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEGKTKAASSMVD

SEQ ID NO: 4154 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDDDRFFPQSGVLIFGKQGSEKTNVDIEKVMITDEEEIRTTNPVATEQYGSVSTNLQRGNRQAATADVN

(The sequence listing continues in the following parts.)

What is claimed is:

1. An adeno-associated virus (AAV) particle comprising a capsid protein comprising amino acid substitutions E531G, K532R, S547A E548G, T550N, V552A, D553A, E555G, K556Q, R585A, and R588A relative to the amino acid sequence of SEQ ID NO: 1, or corresponding substitutions in a wild-type VP1 capsid sequence of an AAV serotype other than AAV2.

2. The AAV particle of claim 1, wherein the capsid protein has an amino acid sequence comprising the amino acid sequence of SEQ ID NO: 4.

3. The AAV particle of claim 1, wherein the AAV particle comprises a recombinant genome comprising at least one heterologous nucleic acid sequence.

4. The AAV particle of claim 3, wherein the heterologous nucleic acid sequence encodes a therapeutic peptide or protein.

5. The AAV particle of claim 4, wherein the therapeutic peptide comprises a repair enzyme, a checkpoint inhibitor, a transcription factor, a growth factor receptor, a growth factor ligand, a tumor suppressor protein, or fragments or combinations thereof.

6. An adeno-associated virus (AAV) particle comprising a capsid protein comprising amino acid substitutions Q263G, S264T, Y444F, T450A, P451E, S452G, T454L, T455K, Q457M, R459H, Q461L, S492D, A493G, D494E, E499D, and Y500F relative to the amino acid sequence of SEQ ID NO: 1, or corresponding substitutions in a wild-type VP1 capsid sequence of an AAV serotype other than AAV2.

7. The AAV particle of claim 6, wherein the capsid protein has an amino acid sequence comprising the amino acid sequence of SEQ ID NO: 6.

8. The AAV particle of claim 6, wherein the AAV particle comprises a recombinant genome comprising at least one heterologous nucleic acid sequence.

9. The AAV particle of claim 8, wherein the heterologous nucleic acid sequence encodes a therapeutic peptide or protein.

10. The AAV particle of claim 9, wherein the therapeutic peptide comprises a repair enzyme, a checkpoint inhibitor, a transcription factor, a growth factor receptor, a growth factor ligand, a tumor suppressor protein, or fragments or combinations thereof.

*    *    *    *    *